(12) United States Patent
Klaenhammer et al.

(10) Patent No.: US 7,459,289 B2
(45) Date of Patent: Dec. 2, 2008

US007459289B2

(54) *LACTOBACILLUS ACIDOPHILUS* NUCLEIC ACID SEQUENCES ENCODING CARBOHYDRATE UTILIZATION-RELATED PROTEINS AND USES THEREFOR

(75) Inventors: Todd R. Klaenhammer, Raleigh, NC (US); Eric Altermann, Apex, NC (US); Rodolphe Barrangou, Madison, WI (US); W. Michael Russell, Newburgh, IN (US); Tri Duong, Raleigh, NC (US)

(73) Assignee: North Carolina State University, Raleigh, NC (US)

( * ) Notice: Subject to any disclaimer, the term of this patent is extended or adjusted under 35 U.S.C. 154(b) by 267 days.

(21) Appl. No.: 11/074,226

(22) Filed: Mar. 7, 2005

(65) Prior Publication Data
US 2007/0003668 A1      Jan. 4, 2007

Related U.S. Application Data

(60) Provisional application No. 60/551,121, filed on Mar. 8, 2004.

(51) Int. Cl.
*C12N 9/24* (2006.01)
*C12N 1/20* (2006.01)
*C12N 15/74* (2006.01)
*C12P 21/06* (2006.01)
*C12P 19/34* (2006.01)
*C07H 21/02* (2006.01)
*C07H 21/04* (2006.01)

(52) U.S. Cl. ............... 435/69.1; 435/200; 435/91.1; 435/252.3; 435/252.9; 435/471; 435/320.1; 536/23.1; 536/23.2; 536/23.7

(58) Field of Classification Search .................. None
See application file for complete search history.

(56) References Cited

U.S. PATENT DOCUMENTS

| | | | |
|---|---|---|---|
| 5,837,509 A | 11/1998 | Israelsen et al. | |
| 6,451,584 B2 | 9/2002 | Tomita et al. | |
| 6,476,209 B1 | 11/2002 | Glenn et al. | |
| 6,544,772 B1 | 4/2003 | Glenn et al. | |
| 6,635,460 B1 | 10/2003 | Van Hijum et al. | |
| 2002/0159976 A1 | 10/2002 | Glenn et al. | |
| 2003/0138822 A1 | 7/2003 | Glenn et al. | |
| 2004/0009490 A1 | 1/2004 | Glenn et al. | |
| 2004/0208863 A1 | 10/2004 | Versalovic et al. | |
| 2005/0003510 A1 | 1/2005 | Chang et al. | |
| 2005/0112612 A1 | 5/2005 | Klaenhammer | |
| 2005/0123941 A1 | 6/2005 | Klaenhammer | |

FOREIGN PATENT DOCUMENTS

| EP | 0 888 118 B1 | 1/1999 |
|---|---|---|
| WO | WO 02/12506 A1 | 2/2002 |
| WO | WO 02/074798 A2 | 9/2002 |
| WO | WO 03/084989 A2 | 10/2003 |
| WO | WO 2004/020467 A2 | 3/2004 |
| WO | WO 2004/031389 A1 | 4/2004 |
| WO | WO 2004/069178 A2 | 8/2004 |
| WO | WO 2004/096992 A2 | 11/2004 |
| WO | WO 2005/001057 A2 | 1/2005 |
| WO | WO 2005/012491 A2 | 2/2005 |

OTHER PUBLICATIONS

Current Protocols in Molecular Biology. Ed., Ausubel et al., Published by John Wiley and Sons Inc. New Yprk, NY, USA., 1990.*
Whisstock et al., Prediction of protein function from protein sequence and structure. Q. Rev. Biophysics., 2003, vol. 36 (3): 307-340.*
Fortina et al., Unusual organization for lactose and galactose gene clusters in *Lactobacillus helveticus*. Appl. Environ. Microbiol., 2003, vol. 69 (9): 3238-3243.*
Guo et al., Protein tolerance to random amino acid change. PNAS., 2004, vol. 101 (25): 9205-9210.*
Witkowski et al., Conversion of b-ketoacyl synthase to a malonyl decarboxylase by replacemnt of the active-site cysteine with glutamine. Biochemistry, 1999, vol. 38: 11643-11650.*
Seffernick et al., Melamine deaminase and Atrazine chlorohydrolase: 98 percent identical but functionally different. J. Bacteriol.,2001, vol. 183 (8): 2405-2410.*
Gmeiner, M., et al., "Influence of a Synbiotic Mixture Consisting of *Lactobacillus acidophilus* 74-2 and a Fructooligosaccharide Preparation on the Microbial Ecology Sustained in a Simulation of the Human Intestinal Microbial Ecosystem (SHIME Reactor)," *Appl. Microbiol. Biotechnol.*, 2000, pp. 219-223, vol. 53.
Losada, M.A., and T. Olleros, "Towards A Healthier Diet for The Colon: The Influence of Fructooligosaccharides and Lactobacilli on Intestinal Health," *Elsevier*, 2002, pp. 71-84. vol. 22.
Oda, Y., and M. Ito, "Characterization of a Mutant From *Lactobacillus amylovorus* JCM 1126T With Improved Utilization of Sucrose," *Current Microbiology*, 2000, pp. 392-395, vol. 41.
Salzberg, S.L., et al. "Microbial Gene Identification Using Interpolated Markov Models," *Nucleic Acids Research*, 1998, pp. 544-548, vol. 26(2).
GenBank Accession No. ADW26650, Fructo-Oligosaccharide Related Protein Encoding DNA, Seq Id 49, 2005.

(Continued)

*Primary Examiner*—Rebecca E. Prouty
*Assistant Examiner*—Ganapathirama Raghu
(74) *Attorney, Agent, or Firm*—Alston & Bird LLP

(57) ABSTRACT

Carbohydrate utilization-related and multidrug transporter nucleic acids and polypeptides, and fragments and variants thereof, are disclosed in the current invention. In addition, carbohydrate utilization-related and multidrug transporter fusion proteins, antigenic peptides, and anti-carbohydrate utilization-related and anti-multidrug transporter antibodies are encompassed. The invention also provides vectors containing a nucleic acid of the invention and cells into which the vector has been introduced. Methods for producing the polypeptides and methods of use for the polypeptides of the invention are further disclosed.

16 Claims, 2 Drawing Sheets

OTHER PUBLICATIONS

Abee et al. (1994) "Kinetic studies of the action of lactacin F, a bacteriocin produced by *Lactobacillus johnsonii* that forms poration complexes in the cytoplasmic membrane" *Appl. Environ. Microbiol.* 60: 1006-1013.

Allison and Klaenhammer (1996) "Functional analysis of the gene encoding immunity to lactacin F, *lafl*, and its use as a *Lactobacillus*-specific, food-grade genetic marker" *Appl. Environ, Microbiol.* 62:4450-4460.

Allison and Klaenhammer (1999) "Genetics of bacteriocins produced by lactic acid bacteria and their use in novel industrial applications" in *Manual of Industrial Microbiology and Biotechnology*. DeMain and Davies (eds.), ASM Press, Washington, D.C., pp. 789-808.

Allison et al. (1994) "Expansion of bacteriocin activity and host range upon complementation of two peptides encoded with the lactacin F operon" *J. Bacteriol.* 176:2235-2241.

Altermann et al. (2004) "Identification and phenotypic characterization of the cell-division protein CdpA" *Gene* 342:189-197.

Altermann et al. (2005) "Complete genome sequence of the probiotic lactic acid bacterium *Lactobacillus acidophilus* NCFM" *Proc. Natl. Acad. Sci. U.S.A.* Early Edition 10.1073/pnas.0409188102, online publication date Jan. 25, 2005.

Azcarate-Peril et al. (2004) "Identification and inactivation of genetic loci involved with *Lactobacillus acidophilus* acid tolerance" *Appl. Environ. Microbiol.* 70:5315-5322.

Barefoot and Klaenhammer (1983) "Detection and activity of lactacin B, a bacteriocin produced by *Lactobacillus acidophilus*" *Appl. Environ. Microbiol.* 45: 1808-1815.

Barefoot and Klaenhammer (1984) "Purification and characterization of the *Lactobacillus acidophilus* bacteriocin lactacin B" *Antimicrob. Agents Chemother.* 26:328-334.

Barefoot et al. (1994) "Identification and purification of a protein that induces production of the *Lactobacillus acidophilus* bacteriocin lactacin B" *Appl. Environ. Microbiol.* 60:3522-3528.

Barrangou et al. (2003) "Functional and comparative genomic analyses of an operon involved in fructooligosaccharide utilization by *Lactobacillus acidophilus*" *Proc. Natl. Acad. Sci. U.S.A.* 100:8957-8962.

Boels et al. (2001) "Functional analysis of the *Lactococcus lactis galU* and *galE* genes and their impact on sugar nucleotide and exopolysaccharide biosynthesis" *Appl. Environ. Microbiol.* 67:3033-3040.

Bruno-Barcena et al. (2004) "Expression of heterologous manganese superoxide dismutase gene in intestinal lactobacilli provides protection against hydrogen peroxide toxicity" *Appl. Environ. Microbiol.* 70:4702-4710.

Christensen et al. (1999) "Peptidases and Amino Acid Catabolism in Lactic Acid Bacteria" *Antonie van Leeuwenhoek* 76: 217-246.

Coconnier et al. (1992) "Protein-mediated adhesion of *Lactobacillus acidophilus* BG2FO4 on human enterocyte and mucus-secreting cell lines in culture" *Appl. Environ. Microbiol.* 58:2034-2039.

Contreras et al. (1997) "Isolation, purification and amino acid sequence of lactobin A, one of the two bacteriocins produced by *Lactobacillus amylovorus* LMG P-13139" *Appl. Environ. Microbiol.* 63:13-20.

De Vuyst and Degeest (1998) "Heteropolysaccharides from lactic acid bacteria" *FEMS Microbiol. Rev.* 23:153-177.

Dodd and Gasson (1994) "Bacteriocins of lactic acid bacteria" In *Genetics and Biotechnology of Lactic Acid Bacteria*. Gasson and De Vos (eds.), Blackie Academic and Professional, London, pp. 211-251.

Fremaux et al. (1993) "Molecular analysis of the lactacin F operon" *Appl. Environ. Microbiol.* 59:3906-3915.

GenBank Accession No. AAA19050; Prolinase; Source: *Lactobacillus helveticus*, Jan. 21, 1994.

GenBank Accession No. AAA25250; Aminopeptidase C.; Source: *Lactobacillus helveticus*, Jan. 13, 1994.

GenBank Accession No. AAB52540; Endopeptidase; Source: *Lactobacillus helveticus*, Apr. 18, 1997.

GenBank Accession No. AAB66326; GroEL; Source: *Lactobacillus zeae*, Aug. 7, 1997.

GenBank Accession No. AAC29003; cochaperonin GroES; Source: *Lactobacillus helveticus*, Aug. 7, 1998.

GenBank Accession No. AAC99363; D-lactate dehydrogenase; Source: *Lactobacillus johnsonni*, Sep. 10, 1999.

GenBank Accession No. AAF22492; F1F0-ATPase subunit a; Source: *Lactobacillus acidophilus*, Aug. 30, 2001.

GenBank Accession No. AAF22493; F1F0-ATPase subunit c; Source: *Lactobacillus acidophilus*, Aug. 30, 2001.

GenBank Accession No. AAF22494; F1F0-ATPase subunit b; Source: *Lactobacillus acidophilus*, Aug. 30, 2001.

GenBank Accession No. AAF22495; F1F0-ATPase subunit delta; Source: *Lactobacillus acidophilus*, Aug. 30, 2001.

GenBank Accession No. AAF22496; F1F0-ATPase subunit Alpha; Source: *Lactobacillus acidophilus*, Aug. 30, 2001.

GenBank Accession No. AAF22497; F1F0-ATPase subunit gamma; Source: *Lactobacillus acidophilus*, Aug. 30, 2001.

GenBank Accession No. AAF22498; F1F0-ATPase subunit beta; Source: *Lactobacillus acidophilus*, Aug. 30, 2001.

GenBank Accession No. AAF22499; F1F0-ATPase subunit epsilon; Source: *Lactobacillus acidophilus*, Aug. 30, 2001.

GenBank Accession No. AAF75593; GroEL; Source: *Lactobacillus johnsonii*, Jun. 13, 2000.

GenBank Accession No. AAK97217; cochaperonin GroES; Source: *Lactobacillus acidophilus*, Sep. 2, 2001.

GenBank Accession No. AAK97218; chaperonin GroEL; Source: *Lactobacillus acidophilus*, Sep. 2, 2001.

GenBank Accession No. AAK97220; cochaperonin GrpE; Source: *Lactobacillus acidophilus*, Sep. 2, 2001.

GenBank Accession No. AAK97221; heat shock protein DnaK; Source: *Lactobacillus acidophilus*, Sep. 2, 2001.

GenBank Accession No. AAQ72431; Endopeptidase E2; Source: *Lactobacillus helveticus*, Sep. 9, 2003.

GenBank Accession No. AAR25444; Tuf; *Lactobacillus johnsonii*, Dec. 3, 2003.

GenBank Accession No. AAT09141; amino acid permease La995; Source: *Lactobacillus acidophilus*, Sep. 7, 2004.

GenBank Accession No. AF010281; *Lactobacillus zeae* GroES; Source: *Lactobacillus zeae*, Aug. 9, 1997.

GenBank Accession No. AF031929; *Lactobacillus helveticus* cochaperonin GroES and chaperonin GroEL genes, complete cds and DNA mismatch repair enzyme (hexA) gene, partial cds; Source: *Lactobacillus helveticus*, Aug. 8, 1998.

GenBank Accession No. AF071558; *Lactobacillus johnsonii* D-lactate dehydrogenase (ldhD) gene, complete cds; Source: *Lactobacillus johnsonii*, Sep. 10, 1999.

GenBank Accession No. AF098522; *Lactobacillus acidophilus* uracil phosphoribosyltransferase; Source: *Lactobacillus acidophilus*, Aug. 30, 2001.

GenBank Accession No. AF214488; *Lactobacillus johnsonii* groESL operon, complete sequence and unknown gene; Source: *Lactobacillus johnsonii*, Jun. 13, 2000.

GenBank Accession No. AF300645; *Lactobacillus acidophilus* groESL operon, complete sequence; Source: *Lactobacillus acidophilus*, Sep. 2, 2001.

GenBank Accession No. AF300646; *Lactobacillus acidophilus* repressor protein HrcA (hrcA) gene, partial cds; cochaperonin GrpE (grpE) and heat shock protein DnaK (dnaK) genes, complete cds, and DnaJ (dnaJ) gene, partical cds; Source: *Lactobacillus acidophilus*, Sep. 2, 2001.

GenBank Accession No. B59088; Prolyl Aminopeptidase; Source: *Lactobacillus helveticus*, Sep. 2, 2001.

GenBank Accession No. CAA42781; D-lactate dehydrogenase; Source: *Lactobacillus delbrueckii*, Nov. 5, 1992.

GenBank Accession No. CAA59019; heat shock induced protein Htpl; Source: *Lactobacillus leichmannii*, Apr. 18, 2005.

GenBank Accession No. CAA61561; SB-protein; *Lactobacillus acidophilus*, Jan. 22, 1996.

GenBank Accession No. CAA86210; Dipeptidase; Source: *Lactobacillus helveticus*, Oct. 17, 1996.

GenBank Accession No. CAB72938; Tripeptidase Enzyme; Source: *Lactobacillus helveticus*, Dec. 23, 2002.

GenBank Accession No. NP_964658; probable xylulose-5-phosphate/fructose-6-phosphate phosphoketolase; Source: *Lactobacillus johnsonii NCC 533*, Oct. 14, 2004.
GenBank Accession No. NP_964694; RecA protein; Source: *Lactobacillus johnsonii NCC 533*, Oct. 14, 2004.
GenBank Accession No. NP_964728; phosphoglycerate kinase; Source: *Lactobacillus johnsonii NCC 533*, Oct. 14, 2004.
GenBank Accession No. NP_964948; DNA-binding protein HU; Source: *Lactobacillus johnsonii NCC 533*, Oct. 14, 2004.
GenBank Accession No. NP_965314; 50S ribosomal protein L19; Source: *Lactobacillus johnsonii NCC 533*, Oct. 14, 2004.
GenBank Accession No. NP_965472; thioredoxin; Source: *Lactobacillus johnsonii NCC 533*, Oct. 14, 2004.
GenBank Accession No. NP_965500; hypothetical protein LJ1693; Source: *Lactobacillus johnsonii NCC 533*, Oct. 14, 2004.
GenBank Accession No. O07684; Beta-galactosidase large subunit; Source: *Lactobacillus acidophilus*, May 1, 2005.
GenBank Accession No. O07685; Beta-galactosidase small subunit; Source: *Lactobacillus acidophilus*, May 1, 2005.
GenBank Accession No. O32755; Glyceraldehyde-3-phosphate dehydrogenase; Source: *Lactobacillus delbrueckii* subsp. *bulgaricus*, Oct. 25, 2004.
GenBank Accession No. O32756; Phosphoglycerate kinase; Source: *Lactobacillus delbrueckii* subsp. *bulgaricus*, Oct. 25, 2004.
GenBank Accession No. O32765; L-lactate dehydrogenase; Source: *Lactobacillus helveticus*, Jan. 25, 2001.
GenBank Accession No. O68324; 60 kDa chaperonin; Source: *Lactobacillus helveticus*, Jun. 15, 2002.
GenBank Accession No. O84913; Xaa-Pro dipeptidase; Source: *Lactobacillus helveticus*, May 1, 2005.
GenBank Accession No. P26297; D-lactate dehydrogenase; Source: *Lactobacillus delbrueckii* subsp. *bulgaricus*, Oct. 25, 2004.
GenBank Accession No. P30901; D-lactate dehydrogenase; Source: *Lactobacillus helveticus*, Oct. 25, 2004.
GenBank Accession No. P34038; Pyruvate kinase; Source: *Lactobacillus delbrueckii* subsp. *bulgaricus*, Jun. 15, 2004.
GenBank Accession No. P35829; S-layer protein precursos; Source: *Lactobacilus acidophilus*, May 1, 2005.
GenBank Accession No. P43451; ATP synthase beta chain; Source: *Enterococcus hirae*, May 1, 2005.
GenBank Accession No. P94870; Aminopeptidase E.; Source: *Lactobacillus helveticus*, May 1, 2005.
GenBank Accession No. Q00052; Galactokinase; Source: *Lactobacillus helveticus*, May 1, 2005.
GenBank Accession No. Q10730; Aminopeptidase N; Source: *Lactobacillus helveticus*, May 1, 2005.
GenBank Accession No. Q10744; Aminopeptidase C.; Source: *Lactobacillus helveticus*, May 1, 2005.
GenBank Accession No. Q48558; Dipeptidase A.; Source: *Lactobacillus helveticus*, May 1, 2005.
GenBank Accession No. Q9Z4H7; Serine protease do-like htrA; Source: *Lactobacillus helveticus*, May 1, 2005.
GenBank Accession No. S47274; Membrane Alanyl Aminopeptidase; Source: *Lactobacillus helveticus*, May 1, 2005.
GenBank Accession No. S47276; Prolinase; Source: *Lactobacillus helveticus*, May 1, 2005.
GenBank Accession No. X60220; *L. delbrueckii* subsp. *bulgaricus* I dhA gene for D-lactate dehydrogenase; Source: *Lactobacillus delbrueckii*, Nov. 5, 1992.
GenBank Accession No. X84261; *L.Leichmannii* xerC, hslU and hslV; Source: *Lactobacillus leichmannii*, Apr. 15, 2005.
GenBank Accession No. X89376; *L. acidophilus* DNA for SB-protein gene; Source: *Lactobacillus acidophilus*, Jan. 22, 1996.
GenBank Accession No. ZP_00046537; COG0124: Histidyl-tRNA synthetase; Source: *Lactobacillus gasseri*, Sep. 30, 2004.
GenBank Accession No. ZP_00046557; COG0148: Enolase; Source: *Lactobacillus gasseri*, Sep. 30, 2004.
GenBank Accession No. ZP_00046583; COG0195: Transcription elongation factor; Source: *Lactobacillus gasseri*, Sep. 30, 2004.
GenBank Accession No. ZP_00047305; COG4690: Dipeptidase; Source: *Lactobacillus gasseri*, Sep. 30, 2004.
GenBank Accession No. ZP_00341831; COG0522: Ribosomal protein S4 and related proteins; Source: *Lactobacillus gasseri*, Sep. 30, 2004.
GenBank Accession No. Q03234; ATP synthetase beta chain; *Lactobacillus casei*, Sep. 30, 2004.
Girgis et al. (2002) "Stress adaptations of lactic acid bacteria" in *Microbial adaptation to stress and safety of new-generation foods*. Yousef and Juneja (eds.) CRC Press, NY, pp. 159-212.
Greene and Klaenhammer (1994) "Factors involved in adherence of lactobacilli to human Caco-2 cells" *Appl. Environ. Microbiol.* 60:4487-4494.
Holzapfel et al. (2001) "Taxonomy and Important Features of Probiotic Microorganisms in Food and Nutrition" *Am J of Clin Nutr* 73 Suppl: 365S-373S.
Hugenholtz et al. (1999) "Metabolic Engineering of Lactic Acid Bacteria: Overview of the Approaches and Results of Pathway Rerouting Involved in Food Fermentations" *Current Opinion in Biotechnology* 10: 492-497.
Joerger and Klaenhammer (1986) "Characterization and purification of helveticin J and evidence for a chromosomally determined bacteriocin produced by *Lactobacillus helveticus*" *J. Bacteriol.* 167:439-446.
Joerger et al. (1990) "Cloning, expression, and nucleotide sequence of the *Lactobacillus helveticus* 481 gene encoding the bactericin helveticin J" *J. Bacteriol.* 172:6339-6347.
Jolly et al. (2002) "Exploiting exopolysaccharides from lactic acid bacteria" *Antonie van Leeuwenhoek* 82:367-374.
Klaenhammer (1988) "Bacteriocins of lactic acid bacteria" *Biochimie* 70:337-349.
Klaenahmmer (1993) "Genetics of bacteriocins produced by lactic acid bacteria" *FEMS Microbiol. Rev.* 12:39-85.
Klaenhammer (2000) "Probiotic bacteria: today and tomorrow" *J. Nutr.* 130(2S Suppl.):415S-416S.
Klaenhammer and Kullen (1999) "Selection and design of probiotics" *Int. J. Food Microbiol.* 50:45-57.
Klaenhammer and Sutherland (1980) "Detection of plasmid deoxyribonucleic acid in an isolate of *Lactobacillus acidophilus*" *Appl. Environ. Microbiol.* 39:671-674.
Klaenhammer et al. (2002) "Discovering lactic acid bacteria by genomics" *Antonie van Leeuwenhoek* 82:29-58.
Kleeman and Klaenhammer (1982) "Adherence of *Lactobacillus* species to human fetal intestinal cells" *J. Dairy Sci.* 65:2063-2069.
Kleerebezem et al. (1999) "Exopolysaccharides produced by *Lactococcus lactis*: from genetic engineering to improved rheological properties?" *Antonie van Leeuwenhoek* 76:357-365.
Kleerebezem et al. (2003) "Complete genome sequence of *Lactobacillus plantarum* WCFS1" *Proc. Natl. Acad. Sci. U.S.A.* 100:1990-1995.
Kok et al. "The Proteolytic System of Lactic Acid Bacteria" *Genetics and Biotechnology of Lactic Acid Bacteria* pp. 169-210, M. Gasson and W.M. DeVos, Eds., Blackie and Professional, London, England (1994).
Konigs et al. (1997) "The role of transport processes in survival of lactic acid bacteria" *Antonie van Leeuwenhoek* 71:117-128.
Konigs et al. (2000) "Lactic acid bacteria: the bugs of the new millennium" *Curr. Opin. Microbiol.* 3:276-282.
Kuipers et al. (2000) "Current Strategies for Improving Food Bacteria" *Res Microbiol* 151: 815-822.
Kullen and Klaenhammer (1999) Identification of the pH-inducible, proton-translocating $F_1F_0$-ATPase (atpBEFHAGDC) operon of *Lactobacillus acidophilus* by differential display: gene structure, cloning and characterization *Mol. Microbiol.* 33: 1152-1161.
Kullen and Klaenhammer (2000) "Genetic modification of intestinal lactobacilli and bifidobacteria" *Curr. Issues Mol. Biol.* 2:41-50.
Kullen et al. (2000) "Use of the DNA sequence of variable regions of the 16S rRNA gene for rapid and accurate identification of bacteria in the *Lactobacillus acidophilus* complex" *J. Appl. Microbiol.* 89:511-516.
La W et al. (1997) "Proteolytic Enzymes of Lactic Acid Bacteria" *Int Dairy Journal* 7: 1-11.
Luchansky et al. (1988) "Application of electroporation for transfer of plasmid DNA to *Lactobacillus, Lactococcus, Leuconostoc,*

*Listeria, Pediococcus, Bacillus, Staphylococcus, Enterococcus* and *Propionobacterium*" *Mol. Microbiol.* 2:637-646.

Luchansky et al. (1989) "Genetic transfer systems for delivery of plasmid deoxyribonucleic acid to *Lactobacillus acidophilus* ADH: conjugation, electroporation and transduction" *J. Dairy Sci.* 72:1408-1417.

Luchansky et al. (1991) "Molecular cloning and deoxyribonucleic acid polymorphisms in *Lactobacillus acidophilus* and *Lactobacillus gasseri*" *J. Dairy Sci.* 74:3293-3302.

Majhenic et al. (2004) "DNA analysis of the genes encoding acidocin LF221 A and acidocin LF221 B, two bacteriocins produced by *Lactobacillus gasseri* LF221" *Appl. Microbiol. Biotechnol.* 63:705-714.

Mohamadzadeh et al. (2005) "Lactobacilli activate human dendritic cells that skew T cells toward T helper I polarization" *Proc. Nat. Acad. Sci. USA* 102:2880-2885.

Muriana and Klaenhammer (1991) "Cloning, phenotypic expression, and DNA sequence of the gene for lactacin F, an antimicrobial peptide produced by *Lactobacillus* spp." *J. Bacteriol.* 173:1779-1788.

Muriana and Klaenhammer (1991) "Purification and partial characterization of lactacin F, a bacteriocin produced by *Lactobacillus acidophilus* 11088" *Appl. Environ. Microbiol.* 57:114-121.

Pao et al. (1998) "Major Facilitator Superfamily" *Microbiol. Mol. Biol. Rev.* 62:1-34.

Poolman (2002) "Transporters and their roles in LAB cell physiology" *Antonie van Leeuwenhoek* 82:147-164.

Pridmore et al. (2004) "The genome sequence of the probiotic intestinal bacterium *Lactobacillus johnsonii* NCC 533" *Proc. Natl. Acad. Sci. U.S.A.* 101:2512-2517.

Putman et al. (2000) "Molecular properties of bacterial multidrug transporters" *Microbiol. Mol. Biol. Rev.* 64:672-693.

Rastall et al. (2005). Modulation of the microbial ecology of the human colon by probiotics, prebiotics and synbiotics to enhance human health: An overview of enabling science and potential applications. *FEMS Microbiol. Ecol.* 52:145-152.

Roy et al. (1993) "Cloning and expression of the manganese superoxide dismutase gene of *Escherichia coli* in *Lactococcus lactis* and *Lactobacillus gasseri*" *Mol. Gen. Genet.* 239:33-40.

Russell and Klaenhammer (2001) "Efficient system for directed integration into the *Lactobacillus acidophilus* and *Lactobacillus gasseri* chromosomes via homologous recombination" *Appl. Environ. Microbiol.* 67:4361-4364.

Russell and Klaenhammer (2001) "Identification and cloning of *gus*A, encoding a new β-glucuronidase from *Lactobacillus gasseri* ADH" *Appl. Environ. Microbiol.* 1253-1261.

Sablon et al. (2000) "Antimicrobiol peptides of lactic acid bacteria: mode of action, genetics and biosynthesis" in *Advances in Biochemical Engineering/Biotechnology*. vol. 68. Schleper (ed.), Springer-Verlag, Berlin, pp. 21-60.

Sanders and Klaenhammer (2001) "Invited review: the scientific basis of *Lactobacillus acidophilus* NCFM functionality as a probiotic" *J. Dairy Sci.* 84:319-331.

Sanders et al. (1996) "Performance of commercial cultures in fluid milk applications", *J. Dairy Sci.* 79:943-955.

Steidler et al. (1998) "Functional display of a heterologous protein on the surface of *Lactococcus lactis* by means of the cell wall anchor of *Staphylococcus aureus* protein A" *Appl. Environ. Microbiol.* 64:342-345.

Sturino and Klaenhammer (2004) "Bacteriophage defense systems for lactic acid bacteria" *Adv. Appl. Microbiol.* 56:331-378.

Ventura et al. (2003) "Analysis, characterization, and loci of the *tuf* genes in *Lactobacillus* and *Bifidobacterium* species and their direct application for species identification" *Appl. Environ. Microbiol.* 69:6908-6922.

Walker et al. (1999) "The *groESL* chaperone operon of *Lactobacillus johnsonii*" *Appl. Environ. Microbiol.* 65:3033-3041.

Yother et al. (2002) Genetics of streptococci, lactococci, and enterococci: review of the sixth international conference *J. Bacteriol.* 184:6085-6092.

\* cited by examiner

LACTOBACILLUS ACIDOPHILUS NUCLEIC ACID SEQUENCES ENCODING CARBOHYDRATE UTILIZATION-RELATED PROTEINS AND USES THEREFOR

CROSS REFERENCE TO RELATED APPLICATIONS

This application claims the benefit of U.S. Provisional Application Ser. No. 60/551,121, filed Mar. 8, 2004, the contents of which are herein incorporated by reference in their entirety.

INCORPORATION OF SEQUENCE LISTING ON COMPACT DISK

The entire contents of the compact disk filed in identical duplicate herewith and containing one file entitled "5051.693 Sequence Listing" (1,313 kb; created Mar. 4, 2005) is incorporated by reference herein.

FIELD OF THE INVENTION

This invention relates to polynucleotides isolated from lactic acid bacteria, namely *Lactobacillus acidophilus*, and polypeptides encoded by them, as well as methods for using the polypeptides and organisms expressing them.

BACKGROUND OF THE INVENTION

*Lactobacillus acidophilus* is a Gram-positive, rod-shaped, non-spore forming, homofermentative bacterium that is a normal inhabitant of the gastrointestinal and genitourinary tracts. Since its original isolation by Moro (1900) from infant feces, the "acid loving" organism has been found in the intestinal tract of humans, breast-fed infants, and persons consuming high milk, lactose, or dextrin diets. Historically, *Lactobacillus acidophilus* is the *Lactobacillus* species most often implicated as an intestinal probiotic capable of eliciting beneficial effects on the microflora of the gastrointestinal tract (Klaenhammer and Russell (2000) "Species of the *Lactobacillus acidophilus* complex," *Encyclopedia of Food Microbiology*, 2:1151-1157. Robinson et al., eds. (Academic Press, San Diego, Calif.). *Lactobacillus acidophilus* can ferment hexoses, including lactose and more complex oligosaccharides, to produce lactic acid and lower the pH of the environment where the organism is cultured. Acidified environments (e.g., food, vagina, and regions within the gastrointestinal tract) can interfere with the growth of undesirable bacteria, pathogens, and yeasts. The organism is well known for its acid tolerance, survival in cultured dairy products, and viability during passage through the stomach and gastrointestinal tract. *Lactobacilli* and other commensal bacteria, some of which are considered probiotic bacteria that "favor life," have been studied extensively for their effects on human health, particularly in the prevention or treatment of enteric infections, diarrheal disease, prevention of cancer, and stimulation of the immune system. *Lactobacilli* have also been studied for their influence on dairy product flavor, and functional and textural characteristics. Genetic characterization of other *Lactobacillus* species (e.g., *L johnsonii* and *L. rhamnosus*) has been described (see e.g., U.S. Pat. No. 6,476,209; U.S. Pat. No. 6,544,772; U.S. Patent Publication Nos. 20020159976, 2003013882 & 20040009490; PCT Publication No. WO 2004/031389; PCT Publication No. 2003/084989; PCT Publication No. WO 2004/020467).

Bacterial growth requires specific transport systems to import nutrients from the external environment. Lactic acid bacteria transport molecules into and out of the cell via three systems: primary transport, secondary transport, and group translocation. In primary transport, chemical (primarily ATP), electrical, or solar energy is used to drive transport. ATP-binding cassette (ABC) transporters are the most abundant class of primary transport systems in lactic acid bacteria. In this system, ATP hydrolysis is linked with substrate translocation across the membrane for both the import of sugars and compatible solutes and the export of products such as drugs or toxins that are undesirable to the cell, or cellular components that function outside of the cell, such as cell wall polysaccharides. In general, ABC transporters are relatively specific for their substrates, but some are multispecific, such as the multidrug transporters.

Secondary transport systems use electrochemical gradients to provide the energy for sugar translocation. They comprise symporters, which cotransport two or more solutes, uniporters, which transport one molecule, and antiporters, which countertransport two or more solutes. Symporters generally couple the uphill movement of the substrate to the downhill movement of a proton (or ion), antiporters use the ion gradient for excretion of a product, and uniporters do not use a coupling ion (Poolman (2002) *Antonie van Leeuwenhoek* 82:147-164).

Group translocation involves the phosphoenolpyruvate (PEP)-dependent phosphotransferase system (PTS), which couples the uptake of a carbohydrate or alditol with its phosphorylation (Poolman (2002), supra). The phosphate group originates from the conversion of PEP into pyruvate, and the subsequent phosphorylation involves the energy coupling proteins, Enzyme I and HPr, as well as substrate-specific phosphoryl transfer proteins IIA, IIB and IIC.

Multidrug transporters may be separated into two major classes, secondary multidrug transporters and ABC transporters. Secondary multidrug transporters may be further divided into distinct families, including the major facilitator superfamily (MFS), the small multidrug resistance family (SMR), the resistance-nodulation-cell division family (RND), and the multidrug and toxic compound extrusion family (MATE) (Putman et al. (2000) *Microbiol. Mol. Biol. Reviews* 64:672-693). Secondary multidrug transporters use the electrochemical gradients, as described herein, to extrude drugs from the cell. ABC-type multidrug transporters use energy from ATP hydrolysis to pump drugs out of the cell (Putman et al. (2000), supra).

Bacteria are able to metabolize various carbohydrates by utilizing transport proteins and enzymes with different carbohydrate specificities, in addition to employing diverse regulatory mechanisms, such as catabolite repression. The isolation and characterization of these proteins allows for the development of essential probiotic products with numerous applications, including those that benefit human and/or animal health, and those concerned with food production and safety. The proteins can also be used in developing transgenic plants with altered growth or survival capabilities.

BRIEF SUMMARY OF THE INVENTION

Compositions and methods for modifying microorganisms and plants are provided. Compositions of the invention include isolated nucleic acids from *Lactobacillus acidophilus* encoding carbohydrate utilization-related proteins, including proteins of the phosphotransferase system (PTS), ABC transporters, and other proteins involved in transport, degradation, and/or synthesis of sugars in *Lactobacillus acidophilus*.

Compositions also include isolated nucleic acids from *Lactobacillus acidophilus* that encode multidrug transporters. Specifically, the present invention provides isolated nucleic acid molecules comprising, consisting essentially of and/or consisting of the nucleotide sequence as set forth in odd numbered SEQ ID NOS:1-321, singly and/or in any combination, and isolated nucleic acid molecules encoding the amino acid sequence as set forth found in even numbered SEQ ID NOS:2-322, singly and/or in any combination. Also provided are isolated and/or recombinant polypeptides comprising, consisting essentially of and/or consisting of an amino acid sequence encoded by a nucleic acid molecule described herein and/or as set forth in even numbered SEQ ID NOS:2-322, singly and/or in any combination. Variant nucleic acids and polypeptides sufficiently identical to the nucleotide sequences and amino acid sequences set forth in the Sequence Listing are encompassed by the present invention. Additionally, fragments and sufficiently identical fragments of the nucleotide sequences and amino acid sequences are encompassed. Nucleotide sequences that are complementary to a nucleic acid sequence of the invention, or that hybridize to a nucleotide sequence of the invention, are also encompassed.

Compositions further include vectors and prokaryotic, eukaryotic and plant cells for recombinant expression of the nucleic acids described herein, as well as transgenic microbial and plant populations comprising the vectors. Also included in the invention are methods for the recombinant production of the polypeptides of the invention, and methods for their use. Further included are methods and kits for detecting the presence of a nucleic acid and/or polypeptide sequence of the invention in a sample, and antibodies that bind to a polypeptide of the invention.

The carbohydrate utilization-related and multidrug transporter molecules of the present invention are useful for the selection and production of recombinant bacteria, particularly the production of bacteria with improved fermentative abilities. Such bacteria include, but are not limited to, bacteria that have a modified ability to synthesize, transport, accumulate, and/or utilize various carbohydrates, bacteria with altered flavors or textures, bacteria that produce altered carbohydrates, and bacteria better able to survive stressful conditions, such as those encountered in food processing and/or in the gastrointestinal tract of an animal. The multidrug transporter molecules of the present invention include those that allow bacteria to better survive contact with antimicrobial polypeptides, such as bacteriocins or other toxins. These carbohydrate utilization-related and multidrug transporter molecules are also useful for modifying plant species. Transgenic plants comprising one or more sequences of the present invention may be beneficial economically in that they are more resistance to environmental stresses, including, but not limited to, plant pathogens, high salt concentration, or dehydration. They may also be better able to withstand food processing and storage conditions.

The present invention provides an isolated nucleic acid selected from the group consisting of a nucleic acid comprising, consisting of and/or consisting essentially of a nucleotide sequence as set forth in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination, including multiples of the same sequence, and/or a complement thereof, a nucleic acid comprising, consisting of and/or consisting essentially of a nucleotide sequence having at least 90% sequence identity to a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination, including multiples of the same sequence, and/or a complement thereof, a nucleic acid comprising, consisting of and/or consisting essentially of a fragment of a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination, including multiples of the same sequence, and/or a complement thereof, a nucleic acid that encodes a polypeptide comprising an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, including multiples of the same sequence, and/or encoded by a nucleic acid molecule described herein, a nucleic acid comprising a nucleotide sequence encoding a polypeptide having at least 90% amino acid sequence identity to the amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, including multiples of the same sequence, and/or encoded by a nucleic acid molecule described herein, and a nucleic acid that hybridizes under stringent conditions to any of the above.

Compositions further include vectors comprising the nucleic acids described herein, vectors further comprising a nucleic acid encoding a heterologous polypeptide, and cells, including bacterial, plant and eukaryotic cells, containing said vectors. Also included in the invention are methods for the recombinant production of the polypeptides of the invention, and methods for their use. Further included are methods and kits for detecting the presence of a nucleic acid or polypeptide sequence of the invention in a sample, and antibodies that bind to a polypeptide of the invention.

The present invention further provides an isolated polypeptide selected from the group consisting of: a) a polypeptide comprising, consisting of and/or consisting essentially of an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, including multiples of the same sequence, and/or encoded by a nucleic acid molecule described herein; b) a polypeptide comprising, consisting of and/or consisting essentially of a fragment of an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, including multiples of the same sequence, and/or encoded by a nucleic acid molecule described herein; c) a polypeptide comprising, consisting of and/or consisting essentially of an amino acid sequence having at least 90% sequence identity with an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, including multiples of the same sequence, and/or encoded by a nucleic acid molecule described herein; d) a polypeptide encoded by a nucleotide sequence having at least 90% sequence identity to a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination; and e) a polypeptide encoded by a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination.

Also provided is a polypeptide of this invention further comprising one or more heterologous amino acid sequences, and antibodies that selectively bind to the polypeptides described herein.

Additionally provided are methods for producing a polypeptide, said method comprising culturing the cell of this invention under conditions in which a nucleic acid encoding the polypeptide is expressed, said polypeptide being selected from the group consisting of: a) a polypeptide comprising an amino acid sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294; 296, 298, 300, 302, 304, 306, 308, 310, 312, 314, 316, 318, 320 and/or 322 in any combination, including multiples of the same sequence, and/or encoded by a nucleic acid molecule described herein; b) a polypeptide comprising a fragment of an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, including multiples of the same sequence, and/or encoded by a nucleic acid molecule described herein; c) a polypeptide comprising an amino acid sequence having at least 90% sequence identity with an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, including multiples of the same sequence, and/or encoded by a nucleic acid molecule described herein; d) a polypeptide encoded by a nucleotide sequence having at least 90% sequence identity to a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination; and e) a polypeptide encoded by a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination.

Also provided are methods for detecting the presence of a polypeptide in a sample, said method comprising contacting the sample with a compound that selectively binds to a polypeptide and determining whether the compound binds to the polypeptide in the sample; wherein said polypeptide is selected from the group consisting of: a) a polypeptide encoded by a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination; b) a polypeptide comprising a fragment of an amino acid sequence encoded by a nucleic acid sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination; c) a polypeptide encoded by a nucleotide sequence having at least 90% sequence identity to a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination; d) a polypeptide comprising an amino acid sequence having at least 90% sequence identity to an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination; and e) a polypeptide comprising an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination.

Additionally provided are methods for detecting the presence of a polypeptide in a sample, said method comprising contacting the sample with a compound that selectively binds to a polypeptide and determining whether the compound binds to the polypeptide in the sample of the invention, wherein the compound that binds to the polypeptide is an antibody. Also provided is a kit comprising a compound for use in the methods of the invention and instructions for use.

The present invention also provides methods for detecting the presence of a nucleic acid molecule and/or fragments thereof of this invention in a sample, comprising: a) contacting the sample with a nucleic acid probe or primer that selectively hybridizes to the nucleic acid molecule and/or fragment thereof; and b) determining whether the nucleic acid probe or primer hybridizes to a nucleic acid molecule in the sample, thereby detecting the presence of a nucleic acid molecule and/or fragment thereof of this invention in the sample. Also provided are methods for detecting the presence of a nucleic acid molecule and/or fragment of the invention in a sample wherein the sample comprises mRNA molecules and is contacted with a nucleic acid probe. Additionally provided herein is a kit comprising a compound that selectively hybridizes to a nucleic acid of the invention, and instructions for use.

Additionally provided are methods for 1) modifying the ability of an organism to transport a carbohydrate into or out of a cell; 2) modifying the ability of an organism to accumulate a carbohydrate; 3) modifying the ability of an organism to utilize a carbohydrate as an energy source; 4) modifying the ability of an organism to produce a modified carbohydrate; 5) modifying the flavor of a food product fermented by a microorganism; 6) modifying the texture of a food product fermented by a microorganism; 7) modifying the ability of an organism to survive food processing and storage conditions; 8) modifying the ability of a microorganism to survive in a gastro-intestinal (GI) tract; 9) modifying the ability of an organism to transport a drug into or out of a cell; and 10) modifying the ability of an organism to produce a carbohydrate, comprising introducing into said organism and/or microorganism a vector comprising at least one nucleotide sequence of this invention and/or at least one nucleotide sequence selected from the group consisting of: a) a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination; b) a nucleotide sequence comprising a fragment of a nucleotide sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination, wherein said fragment encodes a polypeptide that retains activity; c) a nucleotide sequence that is at least 90% identical to the sequence as set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319 and/or 321 in any combination, wherein said nucleotide sequence encodes a polypeptide that retains activity; and d) a nucleotide sequence encoding a polypeptide comprising an amino acid sequence having at least 90% sequence identity to an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination, wherein said polypeptide retains activity; and e) a nucleotide sequence encoding a polypeptide comprising an amino acid sequence as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination.

Further provided herein is 1) a *Lactobacillus acidophilus* bacterial strain with a modified ability to transport a carbohydrate into or out of a cell as compared to a wild-type *Lactobacillus acidophilus;* 2) a *Lactobacillus acidophilus* bacterial strain with a modified ability to accumulate a carbohydrate, as compared to a wild-type *Lactobacillus acidophilus;* 3) a *Lactobacillus acidophilus* bacterial strain with a modified ability to utilize a carbohydrate as an energy source, as compared to a wild-type *Lactobacillus acidophilus;* 4) a *Lactobacillus acidophilus* bacterial strain that provides a food product with a modified flavor as a result of fermentation, as compared to a wild-type *Lactobacillus acidophilus;* 5) a *Lactobacillus acidophilus* bacterial strain that provides a food product with a modified texture as a result of fermentation, as compared to a wild-type *Lactobacillus acidophilus;* 6) a *Lactobacillus acidophilus* bacterial strain with a modified ability to produce a carbohydrate, as compared to a wild-type *Lactobacillus acidophilus;* 7) a *Lactobacillus acidophilus* bacterial strain with a modified ability to survive food processing and storage conditions, as compared to a wild-type *Lactobacillus acidophilus*; and 8) a *Lactobacillus acidophilus* bacterial strain with a modified ability to survive in a GI tract, as compared to a wild-type *Lactobacillus aci-*

*dophilus*, wherein said modified ability, flavor and/or texture is due to expression of at least one carbohydrate utilization-related polypeptide as set forth in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320 and/or 322 in any combination.

Additionally provided is a *Lactobacillus acidophilus* bacterial strain with a modified ability to survive contact with an antimicrobial polypeptide or toxin, as compared to a wild-type *Lactobacillus acidophilus*, wherein said modified ability is due to expression of at least one multidrug transport polypeptide as set forth in even SEQ ID NOs:78-88, 92-94, 124-126, 132, 282-288, 308 and/or 312-322.

Also provided is a plant, a plant cell and/or a seed of a plant, having stably incorporated into its genome a DNA construct comprising at least one nucleotide sequence of this invention and/or at least one nucleotide sequence of this invention, selected from the group consisting of: a) a nucleotide sequence as set forth in any of SEQ ID NOs:1-321, singly and/or in any combination, or a complement thereof; b) a nucleotide sequence having at least 90% sequence identity to a nucleotide sequence as set forth in any of SEQ ID NOs:1-321, singly and/or in any combination, or a complement thereof; c) a nucleotide sequence comprising a fragment of a nucleotide sequence as set forth in any of SEQ ID NOs:1-321, singly and/or in any combination, or a complement thereof; d) a nucleotide sequence that encodes a polypeptide comprising an amino acid sequence as set forth in any of SEQ ID NOs: 2-322; e) a nucleotide sequence that encodes a polypeptide comprising an amino acid sequence having at least 90% sequence identity to the amino acid sequence as set forth in any of SEQ ID NOs:2-322 and f) a nucleotide sequence that hybridizes under stringent conditions to any of are).

DETAILED DESCRIPTION OF THE INVENTION

Figure 1:
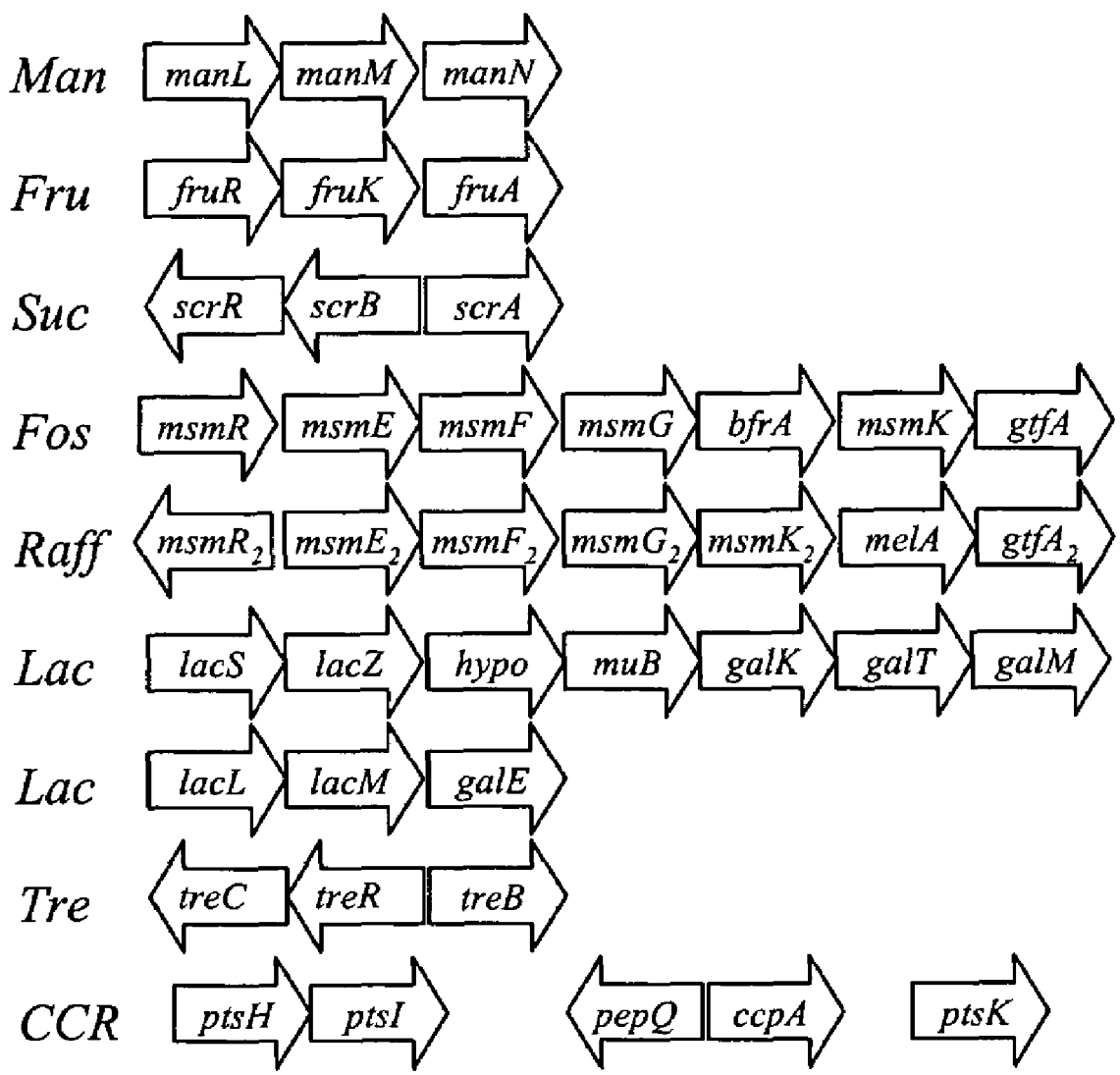
FIG. 1. Genetic loci of interest. The layouts of the loci discussed in the text are shown: man, glucose-mannose locus; fru, fructose locus; suc, sucrose locus; fos, FOS locus; raff, raffinose locus; Lac, lactose-galactose loci; tre, trehalose locus; CCR, carbon catabolite loci.

The present invention relates to carbohydrate utilization-related and multidrug transport molecules from *Lactobacillus acidophilus*. Nucleotide and amino acid sequences of the carbohydrate utilization-related and multidrug transport molecules are provided. The sequences are useful for modifying microorganisms, cells and plants for enhanced properties.

As used herein, "a," "an" and "the" can be plural or singular as used throughout the specification and claims. For example "a" cell can mean a single cell or a multiplicity of cells.

Also as used herein, "and/or" refers to and encompasses any and all possible combinations of one or more of the associated listed items, as well as the lack of combinations when interpreted in the alternative ("or").

By "carbohydrate utilization-related" molecules or genes is meant novel sequences from *Lactobacillus acidophilus* that encode proteins involved in the utilization of carbohydrate molecules, including, but not limited to, the synthesis, transport, or degradation of carbohydrates. By "multidrug transporter" molecules is meant those that are involved in the transport of antimicrobial polypeptides such as bacteriocins, or other drugs or toxins. See Table 1 for specific carbohydrate utilization-related and multidrug transporter molecules of the present invention. The full-length gene sequences are referred to as "carbohydrate utilization-related sequences" or "multidrug transporter sequences," showing that they have similarity to carbohydrate utilization-related genes or multidrug transporter genes, respectively. The invention further provides fragments and variants of these carbohydrate utilization related sequences or multidrug transporter sequences, which can also be used to practice methods of the present invention.

By "carbohydrate" is meant an organic compound containing carbon, hydrogen, and oxygen, usually in the ratio 1:2:1. Carbohydrates include, but are not limited to, sugars, starches, celluloses, and gums. As used herein, the terms "gene" and "recombinant gene" refer to nucleic acids comprising an open reading frame, particularly those encoding a carbohydrate utilization-related protein or a multidrug transporter protein. Isolated nucleic acids of the present invention comprise nucleic acid sequences encoding carbohydrate utilization-related proteins or multidrug transporter proteins, nucleic acid sequences encoding the amino acid sequences set forth in even numbered SEQ ID NOS:2-322, the nucleic acid sequences set forth in odd numbered SEQ ID NOS:1-321, and variants and fragments thereof. The present invention also encompasses antisense nucleic acids, as described below.

In addition, isolated polypeptides and proteins having carbohydrate utilization-related activity or multidrug transporter activity, and variants and fragments thereof, are encompassed, as well as methods for producing those polypeptides. For purposes of the present invention, the terms "protein" and "polypeptide" are used interchangeably. The polypeptides of the present invention have carbohydrate utilization-related protein activity or multidrug transporter activity. Carbohydrate utilization-related protein activity or multidrug transporter activity refers to a biological or functional activity as determined in vivo or in vitro according to standard assay techniques. These activities include, but are not limited to, the ability to synthesize a carbohydrate, the ability to transport a carbohydrate into or out of a cell, the ability to degrade a carbohydrate, the ability to regulate the concentration of a carbohydrate in a cell, the ability to bind a carbohydrate, and the ability to transport a drug or toxin into or out of a cell.

The structures of the various types of bacterial transporters are well known in the art. The ATP-binding cassette (ABC) superfamily of transporters consists of proteins with four core domains (Higgins et al. (1986) *Nature* 323:448-450; Hyde et al. (1990) *Nature* 346:362-365; Higgins (2001) *Res. Microbiol.* 152:205-210). Typically there are two transmembrane domains with six membrane-spanning alpha helices per domain, and two ATP-binding domains that contain the core amino acids by which the transporters are defined (Higgins (2001) supra.), as well as the other conserved motifs including the Walker A and Walker B motifs (Walker et al. (1982) *EMBO J.* 1:945-951; Prosite Ref. No. PDOC00185).

The secondary transport system proteins include the galactoside-pentose-hexuronide group of translocators (Poolman et al. (1996) *Mol. Microbiol.* 19:911-922). These proteins generally consist of a hydrophobic domain comprising twelve membrane spanning domains and a carboxyterminal enzyme IIA domain (Poolman et al. (1989) *J. Bacteriol.* 171:244-253).

The phosphotransferase system (PTS) proteins include enzyme-I (Prosite Ref. No. PDOC00527), the phosphoryl carrier proteins (HPr) (Prosite Ref. No. PDOC00318), and the sugar-specific permease, which consists of at least three structurally distinct domains (Prosite Ref. Nos. PDOC00528; PDOC00795). The HPr protein contains two conserved phosphorylation sites, a histidine residue at the amino-terminal side that is phosphorylated by Enzyme I, and a serine residue at the carboxy-terminal side of the protein that may be phosphorylated by an ATP-dependent protein kinase (de Vos (1996) *Antonie van Leeuwenhoek* 70:223-242).

Members of the major facilitator super family (MFS) of multidrug transporters have either 12 or 14 transmembrane segments. Members of the small multidrug resistance family (SMR) of multidrug transporters are thought to form a tightly packed four-helix antiparallel bundle. Members of the resistance nodulation-cell division family (RND) contain a single N-terminal transmembrane segment and a large C-terminal periplasmic domain (Putman et al. (2000) *Microbiol. Mol. Biol. Reviews* 64:672-693). Conserved motifs within each of these types of multidrug transporters and also throughout the multidrug transporters of the MFS, SMR, and RND families, as well as specific proteins from various bacteria (with Accession Nos.) have been described (Putman et al. (2000) supra).

The nucleic acid and protein compositions encompassed by the present invention are isolated or substantially purified. By "isolated" or "substantially purified" is meant that the nucleic acid or protein molecules, or biologically active fragments or variants thereof, are substantially or essentially free from components normally found in association with the nucleic acid or protein in its natural state. Such components include other cellular material, culture medium from recombinant production, and/or various chemicals used in chemically synthesizing the proteins or nucleic acids. Preferably, an "isolated" nucleic acid of the present invention is free of nucleic acid sequences that flank the nucleic acid of interest in the genomic DNA of the organism from which the nucleic acid was obtained (such as coding sequences present at the 5' or 3' ends). However, the molecule may include some additional bases or moieties that do not deleteriously affect the basic characteristics of the composition. For example, in various embodiments, the isolated nucleic acid contains less than 5 kb, 4 kb, 3 kb, 2 kb, 1 kb, 0.5 kb, or 0.1 kb of nucleic acid sequence normally associated with the genomic DNA in the cells from which it was obtained. Similarly, a substantially purified protein has less than about 30%, 20%, 10%, 5%, or 1% (by dry weight) of contaminating protein, or non-carbohydrate utilization-related protein. When the protein is recombinantly produced, preferably culture medium represents less than 30%, 20%, 10%, or 5% of the volume of the protein preparation, and when the protein is produced chemically, preferably the preparations have less than about 30%, 20%, 10%, or 5% (by dry weight) of chemical precursors, or non-carbohydrate utilization-related chemicals.

The compositions and methods of the present invention can be used to modulate the function of the carbohydrate utilization-related or multidrug transporter molecules of *Lactobacillus acidophilus*. By "modulate," "alter," or "modify" is meant the up- or downregulation of a target biological activity. Proteins of the invention are useful in modifying the biological activities of lactic acid bacteria, and also in modifying the nutritional or health-promoting characteristics of foods fermented by such bacteria. Nucleotide molecules of the invention are useful in modulating carbohydrate utilization-related or multidrug transporter protein expression by lactic acid bacteria. Up- or downregulation of expression from a nucleic acid of the present invention is encompassed. Upregulation may be accomplished, for example, by providing multiple gene copies, modulating expression by modifying regulatory elements, promoting transcriptional or translational mechanisms, or other means. Downregulation may be accomplished, for example, by using known antisense and gene silencing techniques.

By "lactic acid bacteria" is meant bacteria from a genus selected from the following: *Aerococcus, Carnobacterium, Enterococcus, Lactococcus, Lactobacillus, Leuconostoc, Oenococcus, Pediococcus, Streptococcus, Melissococcus, Alloiococcus, Dolosigranulum, Lactosphaera, Tetragenococcus, Vagococcus,* and *Weissella* (Holzapfel et al. (2001) *Am. J. Clin. Nutr.* 73:365S-373S; *Bergey's Manual of Systematic Bacteriology*, Vol. 2 (Williams and Wilkins, Baltimore; (1986)) pp. 1075-1079).

The polypeptides of the present invention or microbes expressing them are useful as nutritional additives or supplements, and as additives in dairy and fermentation processing. The nucleic acid sequences, encoded polypeptides, and microorganisms expressing them are useful in the manufacture of milk-derived products, such as cheeses, yogurt, fermented milk products, sour milks, and buttermilk. Microorganisms that express polypeptides of the invention may be probiotic organisms. By "probiotic" is meant a live microorganism that survives passage through the gastrointestinal tract and has a beneficial effect on the subject. By "subject" is meant an organism that comes into contact with a microorganism expressing a protein of the present invention. Subject may refer to humans and other animals.

In addition to the carbohydrate utilization-related and multidrug transporter nucleotide sequences and fragments and variants thereof as disclosed herein, the nucleic acids of the current invention also encompass homologous nucleic acid sequences identified and isolated from other organisms or cells by hybridization with entire or partial sequences obtained from the carbohydrate utilization-related and multidrug transporter nucleotide sequences or variants and fragments thereof as disclosed herein.

Fragments and Variants

The invention provides isolated nucleic acids comprising nucleotide sequences encoding carbohydrate utilization-related and multidrug transporter proteins, as well as the carbohydrate utilization-related and multidrug transporter proteins encoded thereby. By "carbohydrate utilization-related protein" is meant a protein having an amino acid sequence as set forth in even numbered SEQ ID NOS:2-322. Fragments and variants of these nucleotide sequences and encoded proteins are also provided. By "fragment" of a nucleotide sequence or protein is meant a portion of the nucleotide or amino acid sequence.

Fragments of the nucleic acids disclosed herein can be used as hybridization probes to identify carbohydrate utilization-related-encoding nucleic acids or multidrug transporter-encoding nucleic acids, or can be used as primers in amplification protocols [e.g., polymerase chain reaction (PCR)] or mutation of carbohydrate utilization-related or multidrug transporter nucleic acids. Fragments of nucleic acids of this invention can also be bound to a physical substrate to comprise what may be considered a macro- or microarray (see, for example, U.S. Pat. No. 5,837,832; U.S. Pat. No. 5,861,242; WO 89/10977; WO 89/11548; WO 93/17126; U.S. Pat. No. 6,309,823). Such arrays or "chips" of nucleic acids may be used to study gene expression or to identify nucleic acids with sufficient identity to the target sequences.

The present invention further provides a nucleic acid array or chip, i.e., a multitude of nucleic acids (e.g., DNA) as molecular probes precisely organized or arrayed on a solid support, which allow for the sequencing of genes, the study of mutations contained therein and/or the analysis of the expression of genes, as such arrays and chips are currently of interest given their very small size and their high capacity in terms of number of analyses.

The function of these nucleic acid arrays/chips is based on molecular probes, mainly oligonucleotides, which are attached to a carrier having a size of generally a few square centimeters or more, as desired. For an analysis, the carrier, such as in a DNA array/chip, is coated with DNA probes (e.g., oligonucleotides) that are arranged at a predetermined location or position on the carrier. A sample containing a target nucleic acid and/or fragments thereof to be analyzed, for example DNA or RNA or cDNA, that has been labeled beforehand, is contacted with the DNA array/chip leading to the formation, through hybridization, of a duplex. After a washing step, analysis of the surface of the chip allows any hybridizations to be located by means of the signals emitted by the labeled target. A hybridization fingerprint results, which, by computer processing, allows retrieval of information such as the expression of genes, the presence of specific fragments in the sample, the determination of sequences and/or the identification of mutations.

In one embodiment of this invention, hybridization between target nucleic acids and nucleic acids of the invention, used in the form of probes and deposited or synthesized in situ on a DNA chip/array, can be determined by means of fluorescence, radioactivity, electronic detection or the like, as are well known in the art.

In another embodiment, the nucleotide sequences of the invention can be used in the form of a DNA array/chip to carry out analyses of the expression of *Lactobacillus acidophilus* genes. This analysis is based on DNA array/chips on which probes, chosen for their specificity to characterize a given gene or nucleotide sequence, are present. The target sequences to be analyzed are labeled before being hybridized onto the chip. After washing, the labeled complexes are detected and quantified, with the hybridizations being carried out at least in duplicate. Comparative analyses of the signal intensities obtained with respect to the same probe for different samples and/or for different probes with the same sample, allows, for example, for differential transcription of RNA derived from the sample.

In yet another embodiment, arrays/chips containing nucleotide sequences of the invention can comprise nucleotide sequences specific for other microorganisms, which allows for serial testing and rapid identification of the presence of a microorganism in a sample.

In a further embodiment, the principle of the DNA array/chip can also be used to produce protein arrays/chips on which the support has been coated with a polypeptide and/or an antibody of this invention, or arrays thereof, in place of the nucleic acid. These protein arrays/chips make it possible, for example, to analyze the biomolecular interactions induced by the affinity capture of targets onto a support coated, e.g., with proteins, by surface plasma resonance (SPR). The polypeptides or antibodies of this invention, capable of specifically binding antibodies or polypeptides derived from the sample to be analyzed, can be used in protein arrays/chips for the detection and/or identification of proteins and/or peptides in a sample.

Thus, the present invention provides a microarray or microchip comprising various nucleic acids of this invention in any combination, including repeats, as well as a microarray comprising various polypeptides of this invention in any combination, including repeats. Also provided is a microarray comprising antibodies that specifically react with various polypeptides of this invention, in any combination, including repeats.

By "nucleic acid" is meant DNA molecules (e.g., cDNA or genomic DNA) and RNA molecules (e.g., mRNA) and analogs of the DNA or RNA generated using nucleotide analogs. The nucleic acid can be single-stranded or double-stranded, but is typically double-stranded DNA. A fragment of a nucleic acid encoding a carbohydrate utilization-related protein or a multidrug transporter protein may encode a protein fragment that is biologically active, or it may be used as a hybridization probe or PCR primer as described herein. A biologically active fragment of a polypeptide disclosed herein can be prepared by isolating a portion of one of the nucleotide sequences of the invention, expressing the encoded portion of the protein (e.g., by recombinant expression in vitro), and assessing the activity of the encoded portion of the protein. Fragments of nucleic acids encoding carbohydrate utilization-related or multidrug transporter proteins comprise at least about 5, 10, 15, 20, 25, 30, 35, 40, 45, 50, 75, 100, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1600, 1700, 1800, 1900, 2000, 2200, or 2500 contiguous nucleotides, including any number between 5 and 2500 not specifically recited herein, or up to the total number of nucleotides present in a full-length carbohydrate utilization-related or multidrug transporter nucleotide sequence as disclosed herein (for example, 432 for SEQ ID NO:1, 369 for SEQ ID NO:3, etc.).

Fragments of amino acid sequences include polypeptide fragments suitable for use as immunogens to raise anti-carbohydrate utilization-related or anti-multidrug transporter antibodies. Fragments include peptides comprising amino acid sequences sufficiently identical to or derived from the amino acid sequence of a carbohydrate utilization-related or multidrug transporter protein, or partial-length protein, of the invention and exhibiting at least one activity of a carbohydrate utilization-related or multidrug transporter protein, but which include fewer amino acids than the full-length proteins disclosed herein. Typically, biologically active portions comprise a domain or motif with at least one activity of the carbohydrate utilization-related or multidrug transporter protein. A biologically active portion of a carbohydrate utilization-related or multidrug transporter protein can be a polypeptide that is, for example, 10, 25, 50, 100, 150, 200, 250, 300, 350, 400, 450, 500, 550, 600, 650 contiguous amino acids in length, or any number between 10 and 650 not specifically recited herein, up to the total number of amino acids present in a full-length protein of the current invention (for example, 144 for SEQ ID NO:2, 123 for SEQ ID NO:4, etc.). Such biologically active portions can be prepared by recombinant techniques and evaluated for one or more of the functional activities of a native carbohydrate utilization-related or multidrug transporter protein. As used here, a fragment comprises at least 5 contiguous amino acids of any of even numbered SEQ ID NOS:2-322. The invention encompasses other fragments, however, such as any fragment in the protein greater than 6, 7, 8, or 9 amino acids.

Variants of the nucleotide and amino acid sequences are encompassed in the present invention. By "variant" is meant a sufficiently identical sequence. Accordingly, the invention encompasses isolated nucleic acids that are sufficiently identical to the nucleotide sequences encoding carbohydrate utilization-related proteins and multidrug transporter proteins in even numbered SEQ ID NOS:2-322, or nucleic acids that hybridize to a nucleic acid of odd numbered SEQ ID NOS: 1-321, or a complement thereof, under stringent conditions. Variants also include polypeptides encoded by the variant nucleotide sequences of the present invention. In addition, polypeptides of the current invention have an amino acid sequence that is sufficiently identical to an amino acid sequence set forth in even numbered SEQ ID NOS:1-320. By "sufficiently identical" is meant that a first amino acid or nucleotide sequence contains a sufficient or minimal number of equivalent or identical amino acid residues as compared to a second amino acid or nucleotide sequence, thus providing a common structural domain and/or indicating a common functional activity. Conservative variants include those sequences that differ due to the degeneracy of the genetic code.

In general, amino acid or nucleotide sequences that have at least about 45%, 55%, or 65% identity, preferably at least about 70% or 75% identity, more preferably at least about 80%, 85% or 90%, most preferably at least about 91%, 92%, 93%, 94%, 95%, 95%, 96%, 97%, 98%, or 99% sequence identity to any of the amino acid sequences of even numbered SEQ ID NOS:2-322 or any of the nucleotide sequences of odd numbered SEQ ID NOS:1-321, respectively, are defined herein as sufficiently identical. Variant proteins encompassed by the present invention are biologically active, that is they retain the desired biological activity of the native protein, that is, carbohydrate utilization-related activity or multidrug transporter activity as described herein. A biologically active variant of a protein of the invention may differ from that protein by as few as 1-15 amino acid residues, as few as 1-10, such as 6-10, as few as 5, as few as 4, 3, 2, or even 1 amino acid residue.

Naturally occurring variants may exist within a population (e.g., the *Lactobacillus acidophilus* population). Such variants can be identified by using well-known molecular biology techniques, such as the polymerase chain reaction (PCR), and hybridization as described below. Synthetically derived nucleotide sequences, for example, sequences generated by site-directed mutagenesis or PCR-mediated mutagenesis, that still encode a carbohydrate utilization-related protein or multidrug transporter protein, are also included as variants. One or more nucleotide or amino acid substitutions, additions, or deletions can be introduced into a nucleotide or amino acid sequence disclosed herein, such that the substitutions, additions, or deletions are introduced into the encoded protein. The additions (insertions) or deletions (truncations) may be made at the N-terminal or C-terminal end of the native protein, or at one or more sites in the native protein. Similarly, a substitution of one or more nucleotides or amino acids may be made at one or more sites in the native protein.

For example, conservative amino acid substitutions may be made at one or more predicted, preferably nonessential amino acid residues. A "nonessential" amino acid residue is a residue that can be altered from the wild-type sequence of a protein without altering the biological activity, whereas an "essential" amino acid is required for biological activity. A "conservative amino acid substitution" is one in which the amino acid residue is replaced with an amino acid residue with a similar side chain. Families of amino acid residues having similar side chains are known in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Such substitutions would not be made for conserved amino acid residues, or for amino acid residues residing within a conserved motif, where such residues are essential for protein activity.

Alternatively, mutations can be made randomly along all or part of the length of the carbohydrate utilization-related or multidrug transporter coding sequence, such as by saturation mutagenesis. The mutants can be expressed recombinantly, and screened for those that retain biological activity by assaying for carbohydrate utilization-related or multidrug transporter activity using standard assay techniques. Methods for mutagenesis and nucleotide sequence alterations are known in the art. See, for example, Kunkel (1985) *Proc. Natl. Acad. Sci. USA* 82:488-492; Kunkel et al. (1987) *Methods in Enzymol. Molecular Biology* (MacMillan Publishing Company, New York) and the references sited therein. Obviously the mutations made in the DNA encoding the variant must not disrupt the reading frame and preferably will not create complementary regions that could produce secondary mRNA structure. See, EP Patent Application Publication No. 75,444. Guidance as to appropriate amino acid substitutions that do not effect biological activity of the protein of interest may be found in the model of Dayhoff et al. (1978) *Atlas of Protein Sequence and Structure* (Natl. Biomed. Res. Found., Washington, D.C.), herein incorporated by reference.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays. That is, the activity can be evaluated by comparing the activity of the modified sequence with the activity of the original sequence. See the "Methods of Use" section below for examples of assays that may be used to measure carbohydrate utilization-related activity or multidrug transporter activity.

Variant nucleotide and amino acid sequences of the present invention also encompass sequences derived from mutagenic and recombinogenic procedures such as DNA shuffling. With such a procedure, one or more different carbohydrate utilization-related or multidrug transporter protein coding regions can be used to create a new carbohydrate utilization-related protein or a new multidrug transporter protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the carbohydrate utilization-related or multidrug transporter gene of the invention and other known carbohydrate utilization-related or multidrug transporter genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347;

Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

Variants of the carbohydrate utilization-related and multidrug transporter proteins can function as either agonists (mimetics) or as antagonists. An agonist of the protein can retain substantially the same, or a subset, of the biological activities of the naturally occurring form of the protein. An antagonist of the protein can inhibit one or more of the activities of the naturally occurring form of the protein by, for example, competitively binding to a downstream or upstream member of a cellular signaling cascade that includes the carbohydrate utilization-related or multidrug transporter protein.

Variants of a carbohydrate utilization-related or multidrug transporter protein that function as either agonists or antagonists can be identified by screening combinatorial libraries of mutants, e.g., truncation mutants, of a carbohydrate utilization-related or multidrug transporter protein for agonist or antagonist activity. In one embodiment, a variegated library of carbohydrate utilization-related variants is generated by combinatorial mutagenesis at the nucleic acid level and is encoded by a variegated gene library. A variegated library of carbohydrate utilization-related or multidrug transporter variants can be produced by, for example, enzymatically ligating a mixture of synthetic oligonucleotides into gene sequences such that a degenerate set of potential carbohydrate utilization-related or multidrug transporter sequences is expressible as individual polypeptides, or alternatively, as a set of larger fusion proteins (e.g., for phage display) containing the set of carbohydrate utilization-related or multidrug transporter sequences therein. There are a variety of methods that can be used to produce libraries of potential carbohydrate utilization-related or multidrug transporter variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential carbohydrate utilization-related or multidrug transporter sequences. Methods for synthesizing degenerate oligonucleotides are known in the art (see, e.g., Narang (1983) *Tetrahedron* 39:3; Itakura et al. (1984) *Annu. Rev. Biochem.* 53:323; Itakura et al. (1984) *Science* 198:1056; Ike et al. (1983) *Nucleic Acids Res.* 11:477).

In addition, libraries of fragments of a carbohydrate utilization-related or multidrug transporter protein coding sequence can be used to generate a variegated population of carbohydrate utilization-related or multidrug transporter fragments for screening and subsequent selection of variants of a carbohydrate utilization-related or multidrug transporter protein. In one embodiment, a library of coding sequence fragments can be generated by treating a double-stranded PCR fragment of a carbohydrate utilization-related or multidrug transporter coding sequence with a nuclease under conditions wherein nicking occurs only about once per molecule, denaturing the double-stranded DNA, renaturing the DNA to form double-stranded DNA which can include sense/antisense pairs from different nicked products, removing single-stranded portions from reformed duplexes by treatment with S1 nuclease, and ligating the resulting fragment library into an expression vector. By this method, one can derive an expression library that encodes N-terminal and internal fragments of various sizes of the carbohydrate utilization-related or multidrug transporter protein.

Several techniques are known in the art for screening gene products of combinatorial libraries made by point mutations or truncation and for screening cDNA libraries for gene products having a selected property. Such techniques are adaptable for rapid screening of the gene libraries generated by the combinatorial mutagenesis of carbohydrate utilization-related or multidrug transporter proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique that enhances the frequency of functional mutants in the libraries, can be used in combination with the screening assays to identify carbohydrate utilization-related or multidrug transporter variants (Arkin and Yourvan (1992) *Proc. Natl. Acad. Sci. USA* 89:7811-7815; Delgrave et al. (1993) *Protein Engineering* 6(3):327-331).

Sequence Identity

The carbohydrate utilization-related and multidrug transporter sequences are members of families of molecules with conserved functional features. By "family" is meant two or more proteins or nucleic acids having sufficient nucleotide or amino acid sequence identity. By "sequence identity" is meant the nucleotide or amino acid residues that are the same when aligning two sequences for maximum correspondence over a specified comparison window. By "comparison window" is meant a contiguous segment of the two nucleotide or amino acid sequences for optimal alignment, wherein the second sequence may contain additions or deletions (i.e., gaps) as compared to the first sequence. Generally, for nucleic acid alignments, the comparison window is at least 20 contiguous nucleotides in length, and optionally can be 30, 40, 50, 100, or longer. For amino acid sequence alignments, the comparison window is at least 6 contiguous amino acids in length, and optionally can be 10, 15, 20, 30, or longer. Those of skill in the art understand that to avoid a high similarity due to inclusion of gaps, a gap penalty is typically introduced and is subtracted from the number of matches.

Family members may be from the same or different species, and can include homologues as well as distinct proteins. Often, members of a family display common functional characteristics. Homologues can be isolated based on their identity to the *Lactobacillus acidophilus* carbohydrate utilization-related or multidrug transporter nucleic acid sequences disclosed herein using the cDNA, or a portion thereof, as a hybridization probe according to standard hybridization techniques under stringent hybridization conditions as disclosed below.

To determine the percent identity of two amino acid or nucleotide sequences, an alignment is performed. Percent identity of the two sequences is a function of the number of identical residues shared by the two sequences in the comparison window (i.e., percent identity=number of identical residues/total number of residues×100). In one embodiment, the sequences are the same length. Methods similar to those mentioned below can be used to determine the percent identity between two sequences. The methods can be used with or without allowing gaps. Alignment may also be performed manually by inspection.

When amino acid sequences differ in conservative substitutions, the percent identity may be adjusted upward to correct for the conservative nature of the substitution. Means for making this adjustment are known in the art. Typically the conservative substitution is scored as a partial, rather than a full mismatch, thereby increasing the percentage sequence identity.

Mathematical algorithms can be used to determine the percent identity of two sequences. Non-limiting examples of mathematical algorithms are the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877; the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; and the search-for-local-alignment method of Pearson and Lipman (1988) *Proc. Natl. Acad. Sci. USA* 85:2444-2448.

Various computer implementations based on these mathematical algorithms have been designed to enable the determination of sequence identity. The BLAST programs of Altschul et al. (1990) *J. Mol. Biol.* 215:403 are based on the algorithm of Karlin and Altschul (1990) supra. Searches to obtain nucleotide sequences that are homologous to nucleotide sequences of the present invention can be performed with the BLASTN program, score=100, wordlength=12. To obtain amino acid sequences homologous to sequences encoding a protein or polypeptide of the current invention, the BLASTX program may be used, score=50, wordlength=3. Gapped alignments may be obtained by using Gapped BLAST (in BLAST 2.0) as described in Altschul et al. (1997) *Nucleic Acids Res.* 25:3389. To detect distant relationships between molecules, PSI-BLAST can be used. See, Altschul et al. (1997) supra. For all of the BLAST programs, the default parameters of the respective programs can be used. Alignment may also be performed manually by inspection.

Another program that can be used to determine percent sequence identity is the ALIGN program (version 2.0), which uses the mathematical algorithm of Myers and Miller (1988) supra. A PAM120 weight residue table, a gap length penalty of 12, and a gap penalty of 4 can be used with this program when comparing amino acid sequences.

In addition to the ALIGN and BLAST programs, the BESTFIT, GAP, FASTA and TFASTA programs are part of the GCG Wisconsin Genetics Software Package, Version 10 (available from Accelrys Inc., 9685 Scranton Rd., San Diego, Calif., USA), and can be used for performing sequence alignments. The preferred program is GAP version 10, which used the algorithm of Needleman and Wunsch (1970) supra. Unless otherwise stated the sequence identity values provided herein refer to those values obtained by using GAP Version 10 with the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is meant any sequence comparison program that, for any two sequences in question, generates an alignment having identical nucleotide or amino acid residue matches and an identical percent sequence identity when compared to the corresponding alignment generated by GAP Version 10.

Alignment of a sequence in a database to a queried sequence produced by BLASTN, FASTA, BLASTP or like algorithm is commonly described as a "hit." Hits to one or more database sequences by a queried sequence produced by BLASTN, FASTA, BLASTP or a similar algorithm, align and identify similar portions of a sequence. A hit to a database sequence generally represents an overlap over a fraction of the sequence length of the queried sequence, i.e., a portion or fragment of the queried sequence. However, the overlap can represent the entire length of the queried sequence. The hits in an alignment to a queried sequence produced by BLASTN, FASTA, or BLASTP algorithms to sequences in a database are commonly arranged in order of the degree of similarity and the length of sequence overlap.

Polynucleotide and polypeptide hits aligned by BLASTN, FASTA, or BLASTP algorithms to a queried sequence produce "Expect" values. The Expect value (E value) indicates the number of hits one can "expect" to see over a certain number of contiguous sequences at random when searching a database of a certain size. The Expect value is used as a significance threshold for determining whether the hit to a database, such as the GenBank or the EMBL database, indicates actual similarity. For example, an E value of 0.1 assigned to a polynucleotide hit is interpreted as meaning that in a database of the size of the GenBank database, one might expect to see 0.1 matches over the aligned portion of the sequence with a similar score randomly. By this criterion, the aligned and matched portions of the polynucleotide sequences then have a probability of 90% of being the same. For sequences having an E value of 0.01 or less over aligned and matched portions, the probability of finding a match randomly in the GenBank database is 1% or less, using the BLASTN or FASTA algorithm.

According to an embodiment of this invention, "variant" polynucleotides and polypeptides of this invention, comprise sequences producing an E value of about 0.01 or less when compared to the polynucleotide or polypeptide sequences of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described herein. In other embodiments, a variant polynucleotide is a sequence having the same number of, or fewer nucleic acids than a polynucleotide of the present invention that has at least a 99% probability of being the same as the polynucleotide of the present invention, measured as having an E value of 0.01 or less using the BLASTN or FASTA algorithms set at parameters described herein. Similarly, a variant polypeptide is a sequence having the same number of, or fewer amino acids than a polypeptide of the present invention that has at least a 99% probability of being the same as a polypeptide of the present invention, measured as having an E value of 0.01 or less using the BLASTP algorithm set at the parameters described herein.

As noted above, the percentage identity is determined by aligning sequences using one of the BLASTN, FASTA, or BLASTP algorithms, set at the running parameters described herein, and identifying the number of identical nucleic acids or amino acids over the aligned portions; dividing the number of identical nucleic acids or amino acids by the total number of nucleic acids or amino acids of the polynucleotide or polypeptide sequence of the present invention; and then multiplying by 100 to determine the percent identity. For example, a polynucleotide of the present invention having 220 nucleic acids has a hit to a polynucleotide sequence in the GenBank database having 520 nucleic acids over a stretch of 23 nucleotides in the alignment produced by the BLASTN algorithm using the parameters described herein. The 23 nucleotide hit includes 21 identical nucleotides, one gap and one different nucleotide. The percent identity of the polynucleotide of the present invention to the hit in the GenBank library is thus 21/220 times 100, or 9.5%. The polynucleotide sequence in the GenBank database is thus not a variant of a polynucleotide of the present invention.

Identification and Isolation of Homologous Sequences

Carbohydrate utilization-related nucleotide sequences identified based on their sequence identity to the carbohydrate utilization-related or multidrug transporter nucleotide sequences set forth herein or to fragments and variants thereof are encompassed by the present invention. Methods such as PCR or hybridization can be used to identify sequences from a cDNA or genomic library, for example that are substantially identical to a sequence of the invention. See, for example, Sambrook et al. (1989) *Molecular Cloning: Laboratory Manual* (2d ed., Cold Spring Harbor Laboratory Press, Plainview, N.Y.) and Innis, et al. (1990) *PCR Protocols: A Guide to Methods and Applications* (Academic Press, New York). Methods for construction of such cDNA and genomic libraries are generally known in the art and are also disclosed in the above reference.

In hybridization techniques, the hybridization probes may be genomic DNA fragments, cDNA fragments, RNA fragments, or other oligonucleotides, and may consist of all or part of a known nucleotide sequence disclosed herein. In addition, they may be labeled with a detectable group such as $^{32}$P, or any other detectable marker, such as other radioisotopes, a fluorescent compound, an enzyme, or an enzyme co-factor. Probes for hybridization may be made by labeling synthetic oligonucleotides based on the known carbohydrate utilization-related or multidrug transporter nucleotide sequences disclosed herein. Degenerate primers designed on the basis of conserved nucleotides or amino acid residues in a known carbohydrate utilization-related or multidrug transporter nucleotide sequence or encoded amino acid sequence can additionally be used. The hybridization probe typically comprises a region of nucleotide sequence that hybridizes under stringent conditions to at least about 10, preferably about 20, more preferably about 50, 75, 100, 125, 150, 175, 200, 250, 300, 350, or 400 consecutive nucleotides of a nucleotide sequence of the invention or a fragment or variant thereof. To achieve specific hybridization under a variety of conditions, such probes include sequences that are unique among carbohydrate utilization-related or multidrug transporter protein sequences. Preparation of probes for hybridization is generally known in the art and is disclosed in Sambrook et al. (1989) *Molecular Cloning: A Laboratory Manual* (2d ed., Cold Spring Harbor Laboratory Press, Plainview, N.Y.), herein incorporated by reference.

In one embodiment, the entire nucleotide sequence encoding a carbohydrate utilization-related or multidrug transporter protein is used as a probe to identify novel carbohydrate utilization-related or multidrug transporter sequences and messenger RNAs. In another embodiment, the probe is a fragment of a nucleotide sequence disclosed herein. In some embodiments, the nucleotide sequence that hybridizes under stringent conditions to the probe can be at least about 300, 325, 350, 375, 400, 425, 450, 500, 550, 600, 650, 700, 800, 900, 1000, 1200, 1400, 1600, 1800, or 2000 nucleotides in length.

Substantially identical sequences will hybridize to each other under stringent conditions. By "stringent conditions" is meant conditions under which a probe will hybridize to its target sequence to a detectably greater degree than to other sequences (e.g., at least 2-fold over background). Generally, stringent conditions encompass those conditions for hybridization and washing under which nucleotides having at least about 60%, 65%, 70%, preferably 75% sequence identity typically remain hybridized to each other. Stringent conditions are known in the art and can be found in *Current Protocols in Molecular Biology* (John Wiley & Sons, New York (1989)), 6.3.1-6.3.6. Hybridization typically occurs for less than about 24 hours, usually about 4 to about 12 hours.

Stringent conditions are sequence dependent and will differ in different circumstances. Full-length or partial nucleic acid sequences may be used to obtain homologues and orthologs encompassed by the present invention. By "orthologs" is meant genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

When using probes, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides).

The post-hybridization washes are instrumental in controlling specificity. The two critical factors are ionic strength and temperature of the final wash solution. For the detection of sequences that hybridize to a full-length or approximately full-length target sequence, the temperature under stringent conditions is selected to be about 5° C. lower than the thermal melting point ($T_m$) for the specific sequence at a defined ionic strength and pH. However, stringent conditions would encompass temperatures in the range of 1° C. to 20° C. lower than the $T_m$, depending on the desired degree of stringency as otherwise qualified herein. For DNA-DNA hybrids, the $T_m$ can be determined using the equation of Meinkoth and Wahl (1984) *Anal. Biochem.* 138:267-284: $T_m = 81.5°$ C. $+16.6$ (logM)$+0.41$ (% GC)$-0.61$ (% form)$-500/L$; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe.

The ability to detect sequences with varying degrees of homology can be obtained by varying the stringency of the hybridization and/or washing conditions. To target sequences that are 100% identical (homologous probing), stringency conditions must be obtained that do not allow mismatching. By allowing mismatching of nucleotide residues to occur, sequences with a lower degree of similarity can be detected (heterologous probing). For every 1% of mismatching, the $T_m$ is reduced about 1° C.; therefore, hybridization and/or wash conditions can be manipulated to allow hybridization of sequences of a target percentage identity. For example, if sequences with ≧90% sequence identity are preferred, the $T_m$ can be decreased by 10° C. Two nucleotide sequences could be substantially identical, but fail to hybridize to each other under stringent conditions, if the polypeptides they encode are substantially identical. This situation could arise, for example, if the maximum codon degeneracy of the genetic code is used to create a copy of a nucleic acid.

Exemplary low stringency conditions include hybridization with a buffer solution of 30-35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed.; Cold Spring Harbor Laboratory Press, Plainview, N.Y.).

In a PCR approach, oligonucleotide primers can be designed for use in PCR reactions to amplify corresponding DNA sequences from cDNA or genomic DNA extracted from any organism of interest. PCR primers are preferably at least about 10 nucleotides in length, and most preferably at least about 20 nucleotides in length. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

Assays

Diagnostic assays to detect expression of the disclosed polypeptides and/or nucleic acids as well as their disclosed activity in a sample are disclosed. An exemplary method for detecting the presence or absence of a disclosed nucleic acid or protein comprising the disclosed polypeptide in a sample involves obtaining a sample from a food/dairy/feed product, starter culture (mother, seed, bulk/set, concentrated, dried, lyophilized, frozen), cultured food/dairy/feed product, dietary supplement, bioprocessing fermentate, or a subject that has ingested a probiotic material, and contacting the sample with a compound or an agent capable of detecting the disclosed polypeptides or nucleic acids (e.g., an mRNA or genomic DNA comprising the disclosed nucleic acid or fragment thereof) such that the presence of the disclosed sequence is detected in the sample. Results obtained with a sample from the food, supplement, culture, product, or subject may be compared to results obtained with a sample from a control culture, product, or subject.

One agent for detecting the mRNA or genomic DNA comprising a disclosed nucleotide sequence is a labeled nucleic acid probe capable of hybridizing to the disclosed nucleotide sequence of the mRNA or genomic DNA. The nucleic acid probe can be, for example, a disclosed nucleic acid, such as a nucleic acid of odd numbered SEQ ID NOS:1-321, or a portion thereof, such as a nucleic acid of at least 15, 30, 50, 100, 250, or 500 nucleotides in length and sufficient to specifically hybridize under stringent conditions to the mRNA or genomic DNA comprising the disclosed nucleic acid sequence. Other suitable probes for use in the diagnostic assays of the invention are described herein.

One agent for detecting a protein comprising a disclosed polypeptide sequence is an antibody capable of binding to the disclosed polypeptide, preferably an antibody with a detectable label. Antibodies can be polyclonal, or more preferably, monoclonal. An intact antibody, or a fragment thereof (e.g., Fab or F(ab')$_2$) can be used. The term "labeled," with regard to the probe or antibody, is meant to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

The term "sample" is meant to include tissues, cells, and biological fluids present in or isolated from a subject, as well as cells from starter cultures or food products carrying such cultures, or derived from the use of such cultures. That is, the detection method of the invention can be used to detect mRNA, protein, or genomic DNA comprising a disclosed sequence in a sample both in vitro and in vivo. In vitro techniques for detection of mRNA comprising a disclosed sequence include Northern hybridizations and in situ hybridizations. In vitro techniques for detection of a protein comprising a disclosed polypeptide include enzyme linked immunosorbent assays (ELISAs), Western blots, immunoprecipitations, and immunofluorescence. In vitro techniques for detection of genomic DNA comprising the disclosed nucleotide sequences include Southern hybridizations. Furthermore, in vivo techniques for detection of a protein comprising a disclosed polypeptide include introducing into a subject a labeled antibody against the disclosed polypeptide. For example, the antibody can be labeled with a radioactive marker whose presence and location in a subject can be detected by standard imaging techniques.

In one embodiment, the sample contains protein molecules from a test subject that has consumed a probiotic material. Alternatively, the sample can contain mRNA or genomic DNA from a starter culture.

The invention also encompasses kits for detecting the presence of disclosed nucleic acids or proteins comprising disclosed polypeptides in a sample. Such kits can be used to determine if a microbe expressing a specific polypeptide of the invention is present in a food product or starter culture, or in a subject that has consumed a probiotic material. For example, the kit can comprise a labeled compound or agent capable of detecting a disclosed polypeptide or mRNA in a sample and means for determining the amount of a the disclosed polypeptide in the sample (e.g., an antibody that recognizes the disclosed polypeptide or an oligonucleotide probe that binds to DNA encoding a disclosed polypeptide, e.g., even numbered SEQ ID NOS:2-322). Kits can also include instructions detailing the use of such compounds.

For antibody-based kits, the kit can comprise, for example: (1) a first antibody (e.g., attached to a solid support) that binds to a disclosed polypeptide; and, optionally, (2) a second, different antibody that binds to the disclosed polypeptide or the first antibody and is conjugated to a detectable agent. For oligonucleotide-based kits, the kit can comprise, for example: (1) an oligonucleotide, e.g., a detectably labeled oligonucleotide, that hybridizes to a disclosed nucleic acid sequence or (2) a pair of primers useful for amplifying a disclosed nucleic acid.

The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples that can be assayed and compared to the test sample contained. Each component of the kit is usually enclosed within an individual container, and all of the various containers are within a single package along with instructions for use.

In one embodiment, the kit comprises multiple probes in an array format, such as those described, for example, in U.S. Pat. Nos. 5,412,087 and 5,545,531, and International Publication No. WO 95/00530, herein incorporated by reference. Probes for use in the array may be synthesized either directly onto the surface of the array, as disclosed in International Publication No. WO 95/00530, or prior to immobilization onto the array surface (Gait, ed. (1984) *Oligonucleotide Synthesis a Practical Approach* IRL Press, Oxford, England). The probes may be immobilized onto the surface using techniques well known to one of skill in the art, such as those described in U.S. Pat. No. 5,412,087. Probes may be a nucleic acid or peptide sequence, preferably purified, or an antibody.

The arrays may be used to screen organisms, samples, or products for differences in their genomic, cDNA, polypeptide, or antibody content, including the presence or absence of specific sequences or proteins, as well as the concentration of those materials. Binding to a capture probe is detected, for example, by signal generated from a label attached to the nucleic acid comprising the disclosed nucleic acid sequence, a polypeptide comprising the disclosed amino acid sequence, or an antibody. The method can include contacting the molecule comprising the disclosed nucleic acid, polypeptide, or antibody with a first array having a plurality of capture probes and a second array having a different plurality of capture probes. The results of each hybridization can be compared to analyze differences in expression between a first and second sample. The first plurality of capture probes can be from a control sample, e.g., a wild type lactic acid bacteria, or control subject, e.g., a food, dietary supplement, starter culture sample, or a biological fluid. The second plurality of capture probes can be from an experimental sample, e.g., a mutant type lactic acid bacteria, or subject that has consumed a probiotic material, e.g., a starter culture sample or a biological fluid.

These assays may be especially useful in microbial selection and quality control procedures where the detection of unwanted materials is essential. The detection of particular nucleotide sequences or polypeptides may also be useful in determining the genetic composition of food, fermentation products, or industrial microbes, or microbes present in the digestive system of animals or humans that have consumed probiotics.

Antisense Nucleotide Sequences

The present invention also encompasses antisense nucleic acids, i.e., molecules that are complementary to a sense nucleic acid encoding a protein, e.g., complementary to the coding strand of a double-stranded cDNA molecule, or complementary to an mRNA sequence. Accordingly, an antisense nucleic acid can hydrogen bond to a sense nucleic acid. The antisense nucleic acid can be complementary to an entire carbohydrate utilization-related or multidrug transporter coding strand, or to only a portion thereof, e.g., all or part of the protein coding region (or open reading frame). An antisense nucleic acid can be antisense to a noncoding region of the coding strand of a nucleotide sequence encoding a carbohydrate utilization-related or multidrug transporter protein. The noncoding regions are the 5' and 3' sequences that flank the coding region and are not translated into amino acids. Antisense nucleotide sequences are useful in disrupting the expression of the target gene. Antisense constructions having 70%, preferably 80%, more preferably 85%, 90% or 95% sequence identity to the corresponding sequence may be used.

Given the coding-strand sequence encoding a carbohydrate utilization-related or multidrug transporter protein disclosed herein (e.g., even numbered SEQ ID NOS:2-322), antisense nucleic acids of the invention can be designed according to the rules of Watson and Crick base pairing. The antisense nucleic acid can be complementary to the entire coding region of carbohydrate utilization-related or multidrug transporter mRNA, but more preferably is an oligonucleotide that is antisense to only a portion of the coding or noncoding region of carbohydrate utilization-related or multidrug transporter mRNA. For example, the antisense oligonucleotide can be complementary to the region surrounding the translation start site of carbohydrate utilization-related or multidrug transporter mRNA. An antisense oligonucleotide can be, for example, about 5, 10, 15, 20, 25, 30, 35, 40, 45, or 50 nucleotides in length, or it can be 100, 200 nucleotides, or greater in length. An antisense nucleic acid of the invention can be constructed using chemical synthesis and enzymatic ligation procedures known in the art.

For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, including, but not limited to, for example e.g., phosphorothioate derivatives and acridine substituted nucleotides. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

An antisense nucleic acid of the invention can be an α-anomeric nucleic acid. An α-anomeric nucleic acid forms specific double-stranded hybrids with complementary RNA in which, contrary to the usual β-units, the strands run parallel to each other (Gaultier et al. (1987) *Nucleic Acids Res.* 15:6625-6641). The antisense nucleic acid can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The invention also encompasses ribozymes, which are catalytic RNA molecules with ribonuclease activity that are capable of cleaving a single-stranded nucleic acid, such as an mRNA, to which they have a complementary region. Ribozymes (e.g., hammerhead ribozymes (described in Haselhoff and Gerlach (1988) *Nature* 334:585-591)) can be used to catalytically cleave carbohydrate utilization-related mRNA transcripts to thereby inhibit translation of carbohydrate utilization-related or multidrug transporter mRNA. A ribozyme having specificity for an carbohydrate utilization-related-encoding or multidrug transporter-encoding nucleic acid can be designed based upon the nucleotide sequence of an carbohydrate utilization-related or multidrug transporter cDNA disclosed herein (e.g., odd numbered SEQ ID NOS:1-320). See, e.g., Cech et al., U.S. Pat. No. 4,987,071; and Cech et al., U.S. Pat. No. 5,116,742. Alternatively, carbohydrate utilization-related or multidrug transporter mRNA can be used to select a catalytic RNA having a specific ribonuclease activity from a pool of RNA molecules. See, e.g., Bartel and Szostak (1993) *Science* 261:1411-1418.

The invention also encompasses nucleic acids that form triple helical structures. For example, carbohydrate utilization-related or multidrug transporter gene expression can be inhibited by targeting nucleotide sequences complementary to the regulatory region of the carbohydrate utilization-related or multidrug transporter protein (e.g., the carbohydrate utilization-related or multidrug transporter promoter and/or enhancers) to form triple helical structures that prevent transcription of the carbohydrate utilization-related or multidrug transporter gene in target cells. See generally, Helene (1991) *Anticancer Drug Des.* 6(6):569; Helene (1992) *Ann. N.Y. Acad. Sci.* 660:27; and Maher (1992) *Bioassays* 14(12):807.

In some embodiments, the nucleic acids of the invention can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see Hyrup et al. (1996) *Bioorganic & Medicinal Chemistry* 4:5). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid-phase peptide synthesis protocols as described, for example, in Hyrup et al. (1996) supra; Perry-O'Keefe et al. (1996) *Proc. Natl. Acad. Sci. USA* 93:14670.

PNAs can be used as antisense or antigene agents for sequence-specific modulation of gene expression by, e.g., inducing transcription or translation arrest or inhibiting replication. PNAs of the invention can also be used, e.g., in the analysis of single base pair mutations in a gene by, e.g., PNA-directed PCR clamping; as artificial restriction enzymes when used in combination with other enzymes, e.g., S1 nucleases (Hyrup (1996) supra); or as probes or primers for DNA sequence and hybridization (Hyrup (1996) supra; Perry-O'Keefe et al. (1996) supra).

In another embodiment, PNAs of an carbohydrate utilization-related or multidrug transporter molecule can be modified, e.g., to enhance their stability, specificity, or cellular uptake, by attaching lipophilic or other helper groups to PNA, by the formation of PNA-DNA chimeras, or by the use of liposomes or other techniques of drug delivery known in the art. The synthesis of PNA-DNA chimeras can be performed as described in Hyrup (1996) supra; Finn et al. (1996) *Nucleic Acids Res.* 24(17):3357-63; Mag et al. (1989) *Nucleic Acids Res.* 17:5973; and Peterson et al. (1975) *Bioorganic Med. Chem. Lett.* 5:1119.

Fusion Proteins

The invention also includes carbohydrate utilization-related or multidrug transporter chimeric or fusion proteins. A carbohydrate utilization-related or multidrug transporter "chimeric protein" or "fusion protein" comprises a carbohydrate utilization-related or multidrug transporter polypeptide operably linked to a non-carbohydrate utilization-related or non-multidrug transporter polypeptide, respectively. A "carbohydrate utilization-related polypeptide" or a "multidrug transporter polypeptide" refers to a polypeptide having an amino acid sequence corresponding to a carbohydrate utilization-related protein or a multidrug transporter protein, respectively, whereas a "non-carbohydrate utilization-related polypeptide" or a "non-multidrug transporter polypeptide" refers to a polypeptide having an amino acid sequence corresponding to a protein that is not substantially identical to the carbohydrate utilization-related protein or multidrug transporter protein, respectively, and which is derived from the same or a different organism. Within a carbohydrate utilization-related or multidrug transporter fusion protein, the carbohydrate utilization-related or multidrug transporter polypeptide can correspond to all or a portion of a carbohydrate utilization-related or multidrug transporter protein, preferably including at least one biologically active portion of a carbohydrate utilization-related or multidrug transporter protein. Within the fusion protein, the term "operably linked" is meant to indicate that the carbohydrate utilization-related or multidrug transporter polypeptide and the non-carbohydrate utilization-related or multidrug transporter polypeptide are fused in-frame to each other. The non-carbohydrate utilization-related or multidrug transporter polypeptide can be fused to the N-terminus or C-terminus of the carbohydrate utilization-related or multidrug transporter polypeptide.

Expression of the linked coding sequences results in two linked heterologous amino acid sequences that form the fusion protein. The carrier sequence (the non-carbohydrate utilization-related or non-multidrug transporter polypeptide) can encode a carrier polypeptide that potentiates or increases expression of the fusion protein in the bacterial host. The portion of the fusion protein encoded by the carrier sequence, i.e., the carrier polypeptide, may be a protein fragment, an entire functional moiety, or an entire protein sequence. The carrier region or polypeptide may additionally be designed to be used in purifying the fusion protein, either with antibodies or with affinity purification specific for that carrier polypeptide. Likewise, physical properties of the carrier polypeptide can be exploited to allow selective purification of the fusion protein.

Particular carrier polypeptides of interest include superoxide dismutase (SOD), maltose-binding protein (MBP), glutathione-S-transferase (GST), an N-terminal histidine (His) tag, and the like. This list is not meant to be limiting, as any carrier polypeptide that potentiates expression of the carbohydrate utilization-related protein or multidrug resistance protein as a fusion protein can be used in the methods of the invention.

In one embodiment, the fusion protein is a GST-carbohydrate utilization-related fusion protein in which the carbohydrate utilization-related sequences are fused to the C-terminus of the GST sequences. In another embodiment, the fusion protein is a carbohydrate utilization-related-immunoglobulin fusion protein in which all or part of a carbohydrate utilization-related protein is fused to sequences derived from a member of the immunoglobulin protein family. In other embodiments, the fusion protein comprises a multidrug transporter protein of the present invention. The carbohydrate utilization-related- or multidrug transporter-immunoglobulin fusion proteins of the invention can be used as immunogens to produce anti-carbohydrate utilization-related or anti-multidrug transporter-related antibodies in a subject, to purify carbohydrate utilization-related or multidrug transporter-related ligands, and in screening assays to identify molecules that inhibit the interaction of a carbohydrate utilization-related or multidrug transporter protein with a carbohydrate utilization-related or multidrug transporter ligand.

One of skill in the art will recognize that the particular carrier polypeptide is chosen with the purification scheme in mind. For example, His tags, GST, and maltose-binding protein represent carrier polypeptides that have readily available affinity columns to which they can be bound and eluted. Thus, where the carrier polypeptide is an N-terminal His tag such as hexahistidine ($His_6$ tag), the carbohydrate utilization-related or multidrug transporter fusion protein can be purified using a matrix comprising a metal-chelating resin, for example, nickel nitrilotriacetic acid (Ni-NTA), nickel iminodiacetic acid (Ni-IDA), and cobalt-containing resin (Co-resin). See, for example, Steinert et al. (1997) *QIAGEN News* 4:11-15, herein incorporated by reference in its entirety. Where the carrier polypeptide is GST, the carbohydrate utilization-related or multidrug transporter fusion protein can be purified using a matrix comprising glutathione-agarose beads (Sigma or Pharmacia Biotech); where the carrier polypeptide is a maltose-binding protein (MBP), the carbohydrate utilization-related or multidrug transporter fusion protein can be purified using a matrix comprising an agarose resin derivatized with amylose.

Preferably, a chimeric or fusion protein of the invention is produced by standard recombinant DNA techniques. For example, DNA fragments coding for the different polypeptide sequences may be ligated together in-frame, or the fusion gene can be synthesized, such as with automated DNA synthesizers. Alternatively, PCR amplification of gene fragments can be carried out using anchor primers that give rise to complementary overhangs between two consecutive gene fragments, which can subsequently be annealed and re-amplified to generate a chimeric gene sequence (see, e.g., Ausubel et al., eds. (1995) *Current Protocols in Molecular Biology* (Greene Publishing and Wiley-Interscience, New York). Moreover, a carbohydrate utilization-related or multidrug transporter-encoding nucleic acid can be cloned into a commercially available expression vector such that it is linked in-frame to an existing fusion moiety.

The fusion protein expression vector is typically designed for ease of removing the carrier polypeptide to allow the carbohydrate utilization-related or multidrug transporter protein to retain the native biological activity associated with it. Methods for cleavage of fusion proteins are known in the art. See, for example, Ausubel et al., eds. (1998) *Current Protocols in Molecular Biology* (John Wiley & Sons, Inc.). Chemical cleavage of the fusion protein can be accomplished with reagents such as cyanogen bromide, 2-(2-nitrophenylsulphenyl)-3-methyl-3'-bromoindolenine, hydroxylamine, or low pH. Chemical cleavage is often accomplished under denaturing conditions to cleave otherwise insoluble fusion proteins.

Where separation of the carbohydrate utilization-related or multidrug transporter polypeptide from the carrier polypeptide is desired and a cleavage site at the junction between these fused polypeptides is not naturally occurring, the fusion construct can be designed to contain a specific protease cleavage site to facilitate enzymatic cleavage and removal of the carrier polypeptide. In this manner, a linker sequence comprising a coding sequence for a peptide that has a cleavage site specific for an enzyme of interest can be fused in-frame between the coding sequence for the carrier polypeptide (for example, MBP, GST, SOD, or an N-terminal His tag) and the coding sequence for the carbohydrate utilization-related or multidrug transporter polypeptide. Suitable enzymes having specificity for cleavage sites include, but are not limited to, factor Xa, thrombin, enterokinase, remin, collagenase, and tobacco etch virus (TEV) protease. Cleavage sites for these enzymes are well known in the art. Thus, for example, where factor Xa is to be used to cleave the carrier polypeptide from the carbohydrate utilization-related or multidrug transporter polypeptide, the fusion construct can be designed to comprise a linker sequence encoding a factor Xa-sensitive cleavage site, for example, the sequence IEGR (see, for example, Nagai and Thøgersen (1984) *Nature* 309:810-812, Nagai and Thøgersen (1987) *Meth. Enzymol.* 153:461-481, and Pryor and Leiting (1997) *Protein Expr. Purif.* 10(3):309-319, herein incorporated by reference). Where thrombin is to be used to cleave the carrier polypeptide from the carbohydrate utilization-related or multidrug transporter polypeptide, the fusion construct can be designed to comprise a linker sequence encoding a thrombin-sensitive cleavage site, for example the sequence LVPRGS or VIAGR (see, for example, Pryor and Leiting (1997) *Protein Expr. Purif.* 10(3):309-319, and Hong et al. (1997) *Chin. Med. Sci. J.* 12(3):143-147, respectively, herein incorporated by reference). Cleavage sites for TEV protease are known in the art. See, for example, the cleavage sites described in U.S. Pat. No. 5,532,142, herein incorporated by reference in its entirety. See also the discussion in Ausubel et al., eds. (1998) *Current Protocols in Molecular Biology* (John Wiley & Sons, Inc.), Chapter 16.

Antibodies

An isolated polypeptide of the present invention can be used as an immunogen to generate antibodies that specifically bind carbohydrate utilization-related or multidrug transporter proteins, or stimulate production of antibodies in vivo. The full-length carbohydrate utilization-related or multidrug transporter protein can be used as an immunogen or, alternatively, antigenic peptide fragments of carbohydrate utilization-related or multidrug transporter proteins as described herein can be used. The antigenic peptide of an carbohydrate utilization-related or multidrug transporter protein comprises at least 8, preferably 10, 15, 20, or 30 amino acid residues of the amino acid sequences shown in even numbered SEQ ID NOS:1-320 and encompasses an epitope of a carbohydrate utilization-related or multidrug transporter protein such that an antibody raised against the peptide forms a specific immune complex with the carbohydrate utilization-related or multidrug transporter protein. Preferred epitopes encompassed by the antigenic peptide are regions of a carbohydrate utilization-related or multidrug transporter protein that are located on the surface of the protein, e.g., hydrophilic regions.

Recombinant Expression Vectors and Cells

The nucleic acids of the present invention may be included in vectors, preferably expression vectors. "Vector" refers to a nucleic acid capable of transporting another nucleic acid to which it has been linked. Expression vectors include one or more regulatory sequences and direct the expression of genes to which they are operably linked. By "operably linked" is meant that the nucleotide sequence of interest is linked to the regulatory sequence(s) such that expression of the nucleotide sequence is allowed (e.g., in an in vitro transcription/translation system or in a cell when the vector is introduced into the cell). The term "regulatory sequence" is meant to include controllable transcriptional promoters, operators, enhancers, transcriptional terminators, and other expression control elements such as translational control sequences (e.g., Shine-Dalgarno consensus sequence, initiation and termination codons). These regulatory sequences will differ, for example, depending on the cell being used.

The vectors can be autonomously replicated in a cell (episomal vectors), or may be integrated into the genome of a cell, and replicated along with the host genome (non-episomal mammalian vectors). Integrating vectors typically contain at least one sequence homologous to the bacterial chromosome that allows for recombination to occur between homologous DNA in the vector and the bacterial chromosome. Integrating vectors may also comprise bacteriophage or transposon sequences. Episomal vectors, or plasmids are circular double-stranded DNA loops into which additional DNA segments can be ligated. Plasmids capable of stable maintenance in a host are generally the preferred form of expression vectors when using recombinant DNA techniques.

The expression constructs or vectors encompassed in the present invention comprise a nucleic acid construct of the invention in a form suitable for expression of the nucleic acid in a cell. Expression in prokaryotic cells and plant cells is encompassed in the present invention. It will be appreciated by those skilled in the art that the design of the expression vector can depend on such factors as the choice of the cell to be transformed, the level of expression of protein desired, etc. The expression vectors of the invention can be introduced into cells to thereby produce proteins or peptides, including fusion proteins or peptides, encoded by nucleic acids as described herein (e.g., carbohydrate utilization-related or multidrug transporter proteins, mutant forms of carbohydrate utilization-related or multidrug transporter proteins, fusion proteins, etc.).

Bacterial Expression Vectors

Regulatory sequences include those that direct constitutive expression of a nucleotide sequence as well as those that direct inducible expression of the nucleotide sequence only under certain environmental conditions. A bacterial promoter is any DNA sequence capable of binding bacterial RNA polymerase and initiating the downstream (3') transcription of a coding sequence (e.g., structural gene) into mRNA. A promoter will have a transcription initiation region, which is usually placed proximal to the 5' end of the coding sequence. This transcription initiation region typically includes an RNA polymerase binding site and a transcription initiation site. A bacterial promoter may also have a second domain called an operator, which may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence.

An example of a gene activator protein is the catabolite activator protein (CAP), which helps initiate transcription of the lac operon in *Escherichia coli* (Raibaud et al. (1984) *Annu. Rev. Genet.* 18:173). Regulated expression may therefore be either positive or negative, thereby either enhancing or reducing transcription. Other examples of positive and negative regulatory elements are well known in the art. Various promoters that can be included in the protein expression system include, but are not limited to, a T7/LacO hybrid promoter, a trp promoter, a T7 promoter, a lac promoter, and a bacteriophage lambda promoter. Any suitable promoter can be used to carry out the present invention, including the native promoter or a heterologous promoter. Heterologous promoters may be constitutively active or inducible. A non-limiting example of a heterologous promoter is given in U.S. Pat. No. 6,242,194.

Sequences encoding metabolic pathway enzymes provide particularly useful promoter sequences. Examples include promoter sequences derived from sugar metabolizing enzymes, such as galactose, lactose (lac) (Chang et al. (1987) *Nature* 198:1056), and maltose. Additional examples include promoter sequences derived from biosynthetic enzymes such as tryptophan (trp) (Goeddel et al. (1980) *Nucleic Acids Res.* 8:4057; Yelverton et al. (1981) *Nucleic Acids Res.* 9:731; U.S. Pat. No. 4,738,921; EPO Publication Nos. 36, 776 and 121, 775). The beta-lactamase (bla) promoter system (Weissmann, (1981) "The Cloning of Interferon and Other Mistakes," in *Interferon* 3 (ed. I. Gresser); bacteriophage lambda PL (Shimatake et al. (1981) *Nature* 292:128); the arabinose-inducible araB promoter (U.S. Pat. No. 5,028,530); and T5 (U.S. Pat. No. 4,689,406) promoter systems also provide useful promoter sequences. See also Balbas (2001) *Mol. Biotech.* 19:251-267, where *E. coli* expression systems are discussed.

In addition, synthetic promoters that do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac (Amann et al. (1983) *Gene* 25:167; de Boer et al. (1983) *Proc. Natl. Acad. Sci.* 80:21) and trc (Brosius et al. (1985) *J. Biol. Chem.* 260:3539-3541) promoters are hybrid trp-lac promoters comprised of both trp promoter and lac operon sequences that are regulated by the lac repressor. The tac promoter has the additional feature of being an inducible regulatory sequence. Thus, for example, expression of a coding sequence operably linked to the tac promoter can be induced in a cell culture by adding isopropyl-1-thio-β-D-galactoside (IPTG). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc. Natl. Acad. Sci.* 82:1074). In addition, a hybrid promoter can also be comprised of a bacteriophage promoter and an *E. coli* operator region (EPO Publication No. 267, 851).

The vector may additionally contain a gene encoding the repressor (or inducer) for that promoter. For example, an inducible vector of the present invention may regulate transcription from the Lac operator (LacO) by expressing the gene encoding the LacI repressor protein. Other examples include the use of the lexA gene to regulate expression of pRecA, and the use of trpO to regulate ptrp. Alleles of such genes that increase the extent of repression (e.g., lacIq) or that modify the manner of induction (e.g., lambda CI857, rendering lambda pL thermo-inducible, or lambda CI+, rendering lambda pL chemo-inducible) may be employed.

In addition to a functioning promoter sequence, an efficient ribosome-binding site is also useful for the expression of the fusion construct. In prokaryotes, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of bacterial 16S rRNA (Steitz et al. (1979) "Genetic Signals and Nucleotide Sequences in Messenger RNA," in *Biological Regulation and Development: Gene Expression* (ed. R. F. Goldberger, Plenum Press, NY).

Carbohydrate utilization-related proteins can also be secreted from the cell by creating chimeric DNA molecules that encode a protein comprising a signal peptide sequence fragment that provides for secretion of the carbohydrate utilization-related and multidrug transporter polypeptides in bacteria (U.S. Pat. No. 4,336,336). The signal sequence fragment typically encodes a signal peptide comprised of hydrophobic amino acids that direct the secretion of the protein from the cell. The protein is either secreted into the growth media (Gram-positive bacteria) or into the periplasmic space, located between the inner and outer membrane of the cell (Gram-negative bacteria). Preferably there are processing sites, which can be cleaved either in vivo or in vitro, encoded between the signal peptide fragment and the carbohydrate utilization-related or multidrug transporter protein.

DNA encoding suitable signal sequences can be derived from genes for secreted bacterial proteins, such as the *E. coli* outer membrane protein gene (ompA) (Masui et al. (1983) FEBS Lett. 151(1):159-164; Ghrayeb et al. (1984) *EMBO J.* 3:2437-2442) and the *E. coli* alkaline phosphatase signal sequence (phoA) (Oka et al. (1985) *Proc. Natl. Acad. Sci.* 82:7212). Other prokaryotic signals include, for example, the signal sequence from penicillinase, Ipp, or heat stable enterotoxin II leaders.

Typically, transcription termination sequences recognized by bacteria are regulatory regions located 3' to the translation stop codon and thus, together with the promoter, flank the coding sequence. These sequences direct the transcription of an mRNA that can be translated into the polypeptide encoded by the DNA. Transcription termination sequences frequently include DNA sequences (of about 50 nucleotides) that are capable of forming stem loop structures that aid in terminating transcription. Examples include transcription termination sequences derived from genes with strong promoters, such as the trp gene in *E. coli* as well as other biosynthetic genes.

The expression vectors will have a plurality of restriction sites for insertion of the carbohydrate utilization-related or multidrug transporter sequence so that it is under transcriptional regulation of the regulatory regions. Selectable marker genes that ensure maintenance of the vector in the cell can also be included in the expression vector. Preferred selectable markers include those that confer resistance to drugs such as ampicillin, chloramphenicol, erythromycin, kanamycin (neomycin), and tetracycline (Davies et al. (1978) *Annu. Rev. Microbiol.* 32:469). Selectable markers may also allow a cell to grow on minimal medium, or in the presence of toxic metabolite and may include biosynthetic genes, such as those in the histidine, tryptophan, and leucine biosynthetic pathways.

The regulatory regions may be native (homologous), or may be foreign (heterologous) to the cell and/or the nucleotide sequence of the invention. The regulatory regions may also be natural or synthetic. Where the region is "foreign" or "heterologous" to the cell, it is meant that the region is not found in the native cell into which the region is introduced. Where the region is "foreign" or "heterologous" to the carbohydrate utilization-related or multidrug transporter nucleotide sequence of the invention, it is meant that the region is not the native or naturally occurring region for the operably linked carbohydrate utilization-related or multidrug transporter nucleotide sequence of the invention. For example, the region may be derived from phage. While it may be preferable to express the sequences using heterologous regulatory regions, native regions may be used. Such constructs would be expected in some cases to alter expression levels of carbohydrate utilization-related or multidrug transporter proteins in the cell. Thus, the phenotype of the cell could be altered.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

The invention further provides a recombinant expression vector comprising a DNA molecule of the invention cloned into the expression vector in an antisense orientation. That is, the DNA molecule is operably linked to a regulatory sequence in a manner that allows for expression (by transcription of the DNA molecule) of an RNA molecule that is antisense to carbohydrate utilization-related or multidrug transporter mRNA. Regulatory sequences operably linked to a nucleic acid cloned in the antisense orientation can be chosen to direct the continuous or inducible expression of the antisense RNA molecule. The antisense expression vector can be in the form of a recombinant plasmid or phagemid in which antisense nucleic acids are produced under the control of a high efficiency regulatory region, the activity of which can be determined by the cell type into which the vector is introduced. For a discussion of the regulation of gene expression using antisense genes see Weintraub et al. (1986) *Reviews— Trends in Genetics*, Vol. 1(1).

Alternatively, some of the above-described components can be put together in transformation vectors. Transformation vectors are typically comprised of a selectable market that is either maintained in a replicon or developed into an integrating vector, as described above.

Plant Expression Vectors

For expression in plant cells, the expression cassettes will comprise a transcriptional initiation region operably linked to a nucleotide sequence of the present invention. Various restriction sites may be included in these expression vectors to enable insertion of the nucleotide sequence under the transcriptional regulation of the regulatory regions. Additionally, the expression cassette may contain selectable marker genes, including those genes that provide herbicide or antibiotic resistance, such as tetracycline resistance, hygromycin resistance, ampicillin resistance, or glyphosate resistance.

The expression cassette will include in the 5'-to-3' direction of transcription, a transcriptional and translational initiation region, a nucleotide sequence of the invention, and a transcriptional and translational termination region (i.e., termination region) functional in plants. The termination region may be native with the transcriptional initiation region comprising the promoter nucleotide sequence, may be native with the nucleotide sequence of the invention, or may be derived from another source. Convenient termination regions are known in the art and include, but are not limited to, a termination region from the Ti-plasmid of *A. tumefaciens*, such as the octopine synthase and nopaline synthase termination regions. See also, Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. 1989) *Nucleic Acids Res.* 17:7891-7903; and Joshi et al. (1987) *Nucleic Acid Res.* 15:9627-9639.

The expression cassette comprising a nucleotide sequence of the present invention may also contain at least one additional nucleotide sequence for a gene to be cotransformed into the organism. Alternatively, the additional sequence(s) may be provided on another expression cassette.

The expression cassettes may additionally contain 5' non-translated leader sequences or 5' non-coding sequences. As used herein, "5' leader sequence," "translation leader sequence," or "5' non-coding sequence" refer to that DNA sequence portion of a gene between the promoter and coding sequence that is transcribed into RNA and is present in the fully processed mRNA upstream (5') of the translation start codon. A 5' non-translated leader sequence is usually characterized as that portion of the mRNA molecule that most typically extends from the 5' CAP site to the AUG protein translation initiation codon. The translation leader sequence may affect processing of the primary transcript to mRNA, mRNA stability or translation efficiency (Turner et al. (1995) *Molecular Biotechnology* 3:225). Thus, translation leader sequences play an important role in the regulation of gene expression. Translation leaders are known in the art and include but are not limited to: picornavirus leaders, for example, EMCV leader (Encephalomyocarditis 5' noncoding region) (Elroy-Stein et al. (1989) *Proc. Nat. Acad. Sci. USA* 86:6126-6130); potyvirus leaders, for example, TEV leader (Tobacco Etch Virus) (Allison et al. (1986) *Virology* 154:9-20); MDMV leader (Maize Dwarf Mosaic Virus); human immunoglobulin heavy-chain binding protein (BiP) (Macejak et al. (1991) *Nature* 353:90-94); untranslated leader from the coat protein mRNA of alfalfa mosaic virus (AMV RNA 4) (Jobling et al. (1987) *Nature* 325:622-625); tobacco mosaic virus leader (TMV) (Gallie et al. (1989) *Molecular Biology of RNA*, pages 237-256); and maize chlorotic mottle virus leader (MCMV) (Lommel et al. (1991) *Virology* 81:382-385).

Other methods known to enhance translation and/or mRNA stability can also be utilized, for example, introns, such as the maize ubiquitin intron (Christensen and Quail (1996) *Transgenic Res.* 5:213-218 and Christensen et al. (1992) *Plant Molecular Biology* 18:675-689) or the maize AdhI intron (Kyozuka et al. (1991) *Mol. Gen. Genet.* 228:40-48 and Kyozuka et al. (1990) *Maydica* 35:353-357), and the like. Various intron sequences have been shown to enhance expression, particularly in monocotyledonous cells. The introns of the maize AdhI gene have been found to significantly enhance the expression of the wild-type gene under its cognate promoter when introduced into maize cells. Intron 1 was found to be particularly effective and enhanced expression in fusion constructs with the chloramphenicol acetyltransferase gene (Callis et al. (1987) *Genes Develop.* 1: 1183-1200). In the same experimental system, the intron from the maize bronze1 gene had a similar effect in enhancing expression. The AdhI intron has also been shown to enhance CAT expression 12-fold (Mascarenhas et al. (1990) *Plant Mol. Biol.* 6:913-920). Intron sequences have routinely been incorporated into plant transformation vectors, typically within the non-translated leader.

The expression cassette comprising a promoter sequence of the present invention may additionally contain a 3' noncoding sequence. A "3' non-coding sequence" or "3' non-translated region" refers to a nucleotide sequence located 3' (downstream) to a coding sequence and includes polyadenylation signal sequences and other sequences encoding regulatory signals capable of affecting the addition of polyadenylic acid tracts to the 3' end of the mRNA precursor. A 3' non-translated region comprises a region of the mRNA generally beginning with the translation termination codon and extending at least beyond the polyadenylation site. Non-translated sequences located in the 3' end of a gene have been found to influence gene expression levels. Ingelbrecht et al. (see, *Plant Cell,* 1:671-680, 1989) evaluated the importance of these elements and found large differences in expression in stable plants depending on the source of the 3' non-translated region. Using 3' non-translated regions associated with octopine synthase, 2S seed protein from *Arabidopsis*, small subunit of rbcS from *Arabidopsis*, extension from carrot, and chalcone synthase from Antirrhinium, a 60-fold difference was observed between the best-expressing construct (which contained the rbcS 3' non-translated region) and the lowest-expressing construct (which contained the chalcone synthase 3' region).

Transcription levels may also be increased by the utilization of enhancers in combination with the promoter regions of the invention. Enhancers are nucleotide sequences that act to increase the expression of a promoter region. Enhancers are known in the art and include the SV40 enhancer region, the 35S enhancer element, and the like.

In preparing the expression cassette, the various DNA fragments may be manipulated, so as to provide for the DNA sequences in the proper orientation and, as appropriate, in the proper reading frame. Adapters or linkers may be employed to join the DNA fragments or other manipulations may be involved to provide for convenient restriction sites. Restriction sites may be added or removed, superfluous DNA may be removed, or other modifications may be made to the sequences of the invention. For this purpose, in vitro mutagenesis, primer repair, restriction, annealing, resubstitutions, for example, transitions and transversions, may be involved.

In addition to selectable markers that provide resistance to antibiotics or herbicides, as described above, other genes that could serve utility in the recovery of transgenic events but might not be required in the final product would include, but are not limited to, GUS (b-glucoronidase; Jefferson (1987) *Plant Mol. Biol. Rep.* 5:387), GFP (green florescence protein; Chalfie et al. (1994) *Science* 263:802), luciferase (Riggs et al. (1987) *Nucleic Acids Res.* 15(19):8115 and Luehrsen et al. (1992) *Methods Enzymol.* 216:397-414), and the maize genes encoding for anthocyanin production (Ludwig et al. (1990) *Science* 247:449).

The nucleic acids of the present invention are useful in methods directed to expressing a nucleotide sequence in a plant. This may be accomplished by transforming a plant cell of interest with an expression cassette comprising a promoter operably linked to a nucleotide sequence identified herein, and regenerating a stably transformed plant from said plant cell. The expression cassette comprising the promoter sequence operably linked to a nucleotide sequence of the present invention can be used to transform any plant. In this manner, genetically modified, i.e. transgenic or transformed, plants, plant cells, plant tissue, seed, root, and the like can be obtained.

Microbial or Bacterial Cells

The production of bacteria containing heterologous phage resistance genes, the preparation of starter cultures of such bacteria, and methods of fermenting substrates, particularly food substrates such as milk, may be carried out in accordance with known techniques.

By "introducing" as it pertains to nucleic acids is meant introduction into prokaryotic or eukaryotic cells via conventional transformation or transfection techniques, or by phage-mediated infection. As used herein, the terms "transformation," "transduction," "conjugation," and "protoplast fusion" are meant to refer to a variety of art-recognized techniques for introducing foreign nucleic acid (e.g., DNA) into a cell, including calcium phosphate or calcium chloride co-precipitation, DEAE-dextran-mediated transfection, lipofection, or electroporation. Suitable methods for transforming or transfecting cells can be found in Sambrook et al. (1989) *Molecular Cloning: A Laboratory Manual* (2d ed., Cold Spring Harbor Laboratory Press, Plainview, N.Y.) and other laboratory manuals. By "introducing" as it pertains to polypeptides or microorganisms of the invention, is meant introduction into a host by ingestion, topical application, nasal, suppository, urogenital, or oral application of the polypeptide or microorganism.

Bacterial cells used to produce the carbohydrate utilization-related or multidrug transporter polypeptides of this invention are cultured in suitable media, as described generally in Sambrook et al. (1989) *Molecular Cloning, A Laboratory Manual* (2d ed., Cold Spring Harbor Laboratory Press, Plainview, N.Y.

Transgenic Plants and Plant Cells

As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant expression cassette. It is to be understood that as used herein the term "transgenic" includes any cell, cell line, callus, tissue, plant part, or plant the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

A transgenic "event" is produced by transformation of plant cells with a heterologous DNA construct, including a nucleic acid expression cassette that comprises a transgene of interest, the regeneration of a population of plants resulting from the insertion of the transgene into the genome of the plant, and selection of a particular plant characterized by insertion into a particular genome location. An event is characterized phenotypically by the expression of the transgene. At the genetic level, an event is part of the genetic makeup of a plant. The term "event" also refers to progeny produced by a sexual outcross between the transformant and another variety that includes the heterologous DNA.

As used herein, the term "plant" includes reference to whole plants, plant organs (e.g., leaves, stems, roots, etc.), seeds, plant cells, and progeny of same. Parts of transgenic plants within the scope of the invention are to be understood to comprise, for example, plant cells, protoplasts, tissues, callus, embryos as well as flowers, stems, fruits, ovules, leaves, or roots originating in transgenic plants or their progeny previously transformed with a DNA molecule of the invention, and therefore consisting at least in part of transgenic cells.

As used herein, the term "plant cell" includes, without limitation, seeds suspension cultures, embryos, meristematic regions, callus tissue, leaves, roots, shoots, gametophytes, sporophytes, pollen, and microspores. The class of plants that can be used in the methods of the invention is generally as broad as the class of higher plants amenable to transformation techniques, including both monocotyledonous and dicotyledonous plants.

The present invention may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassaya (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*).

The methods of the invention do not depend on a particular method for introducing a nucleotide construct to a plant, only that the nucleotide construct gains access to the interior of at least one cell of the plant. Methods for introducing nucleotide constructs into plants are known in the art including, but not limited to, stable transformation methods, transient transformation methods, and virus-mediated methods.

By "transient transformation" it is meant that a nucleotide construct introduced into a plant does not integrate into the genome of the plant. By "stable transformation" it is meant that the nucleotide construct introduced into a plant integrates into the genome of the plant and is capable of being inherited by progeny thereof. "Primary transformant" and "T0 generation" transgenic plants are of the same genetic generation as the tissue that was initially transformed (i.e., not having gone through meiosis and fertilization since transformation). "Secondary transformants" and "T1, T2, T3, and subsequent generations" refer to transgenic plants derived from primary transformants through one or more meiotic and fertilization cycles. They may be derived by self-fertilization of primary or secondary transformants or crosses of primary or secondary transformants with other transformed or untransformed plants.

Transformation protocols as well as protocols for introducing nucleotide sequences into plants may vary depending on the type of plant or plant cell, i.e., monocot or dicot, targeted for transformation. The nucleotide constructs of the invention may be introduced into plants by any method known in the art, including, but not limited to, contacting the plants with a virus or viral nucleic acids (see, for example, U.S. Pat. Nos. 5,889, 191, 5,889,190, 5,866,785, 5,589,367, and 5,316,931; herein incorporated by reference), microinjection (Crossway et al. (1986) *Biotechniques* 4:320-334), electroporation (Riggs et al. (1986) *Proc. Natl. Acad. Sci. USA* 83:5602-5606, Agrobacterium-mediated transformation (U.S. Pat. Nos. 5,981, 840 and 5,563,055), direct gene transfer (Paszkowski et al. (1984) *EMBO J.* 3:2717-2722), and ballistic particle acceleration (see, for example U.S. Pat. Nos. 4,945,050; 5,879, 918; 5,886,244; and 5,932,782); all of which are herein incorporated by reference.

The transformed cells may be grown into plants with methods known in the art. See, for example, McCormick et al. (1986) *Plant Cell Reports* 5:81-84. These plants may then be grown, and either pollinated with the same transformed strain or different strains, and the resulting hybrid having expression of the desired phenotypic characteristic identified. Two or more generations may be grown to ensure that expression of the desired phenotypic characteristic is stably maintained and inherited and then seeds may be harvested to ensure expression of the desired phenotypic characteristic has been achieved. Thus as used herein, "transformed seeds" refers to seeds that contain the nucleotide construct stably integrated into the plant genome.

Methods of Use

Methods are provided for modifying expression of carbohydrate utilization-related or multidrug transporter genes or proteins of an organism. In one embodiment, properties of microorganisms used in fermentation are modified to provide strains able to utilize alternative carbohydrates for energy or carbon sources. These modifications may result in a new ability to synthesize, transport, accumulate, or degrade a carbohydrate. Alternatively, these modifications may result in the ability to survive contact with antimicrobial polypeptides, including antibiotics and toxins. These new abilities may also allow the microorganisms to better survive stressful conditions, such as the digestive tract or those found during food processing and storage, which will increase the utility of these microorganisms in fermenting various foods, as well as allowing them to provide longer-lasting probiotic activity after ingestion. These new abilities may also allow the microorganisms to generate different flavors or textures in a product upon fermentation. In addition, the new abilities may enable a bacterium to produce a modified carbohydrate, exopolysaccharide, or cell surface polysaccharide. In another embodiment, the properties of plants are modified to provide similar abilities. These abilities are provided by the nucleotide and amino acid sequences disclosed in the present invention.

In general, the methods comprise introducing or overexpressing one or more proteins involved in carbohydrate utilization or multidrug resistance. By "introducing" is meant that the protein of interest is expressed in a modified cell when it was not expressed in an unmodified cell. By "overexpressing" is meant that the protein of interest is expressed in an increased amount in the modified organism compared to its production in the unmodified wild-type organism. Homofermentative lactic acid bacteria, in particular, have a relatively simple metabolism, with almost no overlap between energy metabolism and biosynthesis metabolism, making them ideal targets for metabolic engineering (Hugenholz and Kleerebezem (1999) *Current Opin. Biotech.* 10:492-497). The expression of bacterial genes in plants is well known in the art. See, for example, Shewmaker et al. (1994) *Plant Physiol.* 104:1159-1166; Shen et al. (1997) *Plant Physiol.* 113:1177-1183; Blaszczyk et al. (1999) *Plant J.* 20:237-243.

Expression of one or more carbohydrate utilization-related or multidrug transporter proteins may allow for an organism to have a modified ability to transport a carbohydrate or an antimicrobial polypeptide such as a bacteriocin into or out of a cell. Transport-related carbohydrate utilization proteins or multidrug transporter proteins comprise ABC transporter system components including substrate-binding proteins (for example HisJ and MalE), membrane-associated components such as permeases (for example LacF and LacG), and cytoplasmic proteins such as ATP-binding proteins (for example msmK). Transport-related carbohydrate utilization proteins or multidrug transporter proteins also comprise secondary transport system proteins such as those in the major facilitator superfamily (MFS) and the glycoside/pentoside/hexuronide family. Group translocation system proteins are also included, including enzyme I, enzyme II, and HPr proteins.

Methods are known in the art for cloning and expressing carbohydrate utilization-related proteins in microorganisms and plants, and for assessing function of those proteins (see, for example, de Vos (1996) *Antonie van Leeuwenhoek* 70:223-242; Yeo et al. (2000) *Mol. Cells* 10:263-268; Goddijn et al. (1997) *Plant Physiol.* 113:181-190). Function for primary and secondary transport system-related proteins may be assessed, for example, by enzyme assays, fermentation assays, and transport assays. Function for group translocation system-related proteins may be assessed, for example, by sugar phosphorylation assays. See, for example, Russell et al. (Russell et al. (1992) *J. Biol. Chem.* 267:4631-4637), where genes from a primary transport system (msm) in *Streptococcus mutans* are identified and expressed in *E. coli*; Leong-Morgenthaler et al. (Leong-Morgenthaler et al. (1991) *J. Bacteriol.* 173:1951-1957, where two genes from a secondary transport system (lactose) from *Lactobacillus bulgaricus* were cloned and expressed in *E. coli*; Vaughan et al. (Vaughan et al. (1996) *Appl. Env. Microbiol.* 62:1574-1582), where a secondary transport system (lacS) gene from *Leuconostoc lactis* was cloned and expressed in *E. coli*; de Vos et al. (de Vos et al. (1990) *J. Biol. Chem.* 265:22554-22560), where two PTS system genes from *Lactococcus lactis* were identified, cloned and expressed in *E. coli* and *Lactobacillus lactis*; Sato et al. (Sato et al. (1989) *J. Bacteriol.* 171:263-271), where the scrA gene from *Streptococcus mutans* was cloned into *E. coli* and found to exhibit sucrose PTS activity; Alpert and Chassy (Alpert and Chassy (1990) *J. Biol. Chem.* 265:22561-22568), where the gene coding for the lactose-specific Enzyme II of *Lactobacillus casei* was cloned and expressed in *E. coli*; Boyd et al. (Boyd et al. (1994) *Infect. Immun.* 62:1156-1165), where the genes that encode HPr and Enzyme I of the PTS transport system of *Streptococcus mutans* were cloned and expressed in *E. coli*; Garg et al. (Garg et al. (2002) *Proc. Natl. Acad. Sci. USA* 99:15898-15903), where the overexpression of *E. coli* trehalose biosynthetic genes otsA and otsB led to increased tolerance of the transgenic plants to abiotic stress, and enhanced productivity; and Grinius and Goldberg (Grinius and Goldberg (1994) *J. Biol. Chem.* 269:29998-30004), where a multidrug resistance protein was expressed and demonstrated to function as a drug pump.

Expression of one or more carbohydrate utilization-related proteins may allow for an organism to have a modified ability to accumulate a carbohydrate in the cytoplasm of a cell. For example, introducing or overexpressing an enzyme involved in sugar catabolism without expressing a relevant transport protein may lead to an accumulation of that carbohydrate in the cytoplasm. Alternatively, introduction or overexpression of a carbohydrate transport-related protein may lead to enhanced transport of the carbohydrate into the external environment. Methods are known in the art for introducing or expressing carbohydrate-related genes in organisms. Accumulation of a carbohydrate in a cell may be assessed, for example, by chromatographic methods or enzyme assays. See, for example, Chaillou et al. (1998) *J. Bacteriol.* 180: 4011-4014 and Goddijn et al. (1997) supra.

Expression of one or more carbohydrate utilization-related proteins may allow for an organism to have a modified ability to utilize or produce a carbohydrate as an energy source. Methods are known in the art for cloning and expressing carbohydrate utilization-related proteins in organisms, and for assessing function of those proteins (see, for example, de Vos (1996) *Antonie van Leeuwenhoek* 70:223-242; Hugenholz et al. (2002) *Antonie van Leeuwenhoek* 82:217-235). For example, the genes for lactose metabolism may be introduced into a bacterium to improve the utilization of lactose, and to produce a product more acceptable to lactose-intolerant people (Hugenholz et al. (2002) supra). Further modifications may be made in these modified bacteria, such as blocking glucose metabolism so that glucose is not degraded, but is released from the cell into the medium, thereby providing natural sweetness. See, for example (Hugenholz et al. (2002) supra). Alternatively, the genes for galactose metabolism as well as the gene for α-phosphoglucomutase may be introduced, to improve the galactose-fermenting capability of the microorganism, thereby aiding in preventing the consumption of high levels of galactose, which could cause health problems (Hugenholz et al. (2002) supra; Hirasuka and Li (1992) *J. Stud. Alcohol* 62:397-402). One gene associated with galactose metabolism is α-galactosidase, the expression of which may be useful for removing raffinose-type sugars from fermented products, since monogastric animals cannot degrade them (Hugenholz et al. (2002) supra). Expression of the bacterial gene for mannitol-1-phosphate dehydrogenase (mt1D) in tobacco plants successfully resulted in the synthesis and accumulation of mannitol (Tarczynski et al. (1992) *Proc. Natl. Acad. Sci. USA* 89:2600-2604).

Function of the various carbohydrate-related proteins may be assessed, for example, by microbial growth assays, transport assays, enzyme assays, or analysis by chromatography methods and NMR. See, for example, Djordjevic et al. (2001) *J. Bacteriol.* 183:3224-3236; Chaillou et al. (1998) *J. Bacteriol.* 180:4011-4014; and Tarczynski et al. (1992) supra.

Generally, permeases, membrane-associated enzymes, and regulators such as transcriptional repressors or antiterminators may need to be expressed in the cell for optimal utilization of a carbohydrate. The function of transcriptional antiterminators may be assayed by antitermination activity in a reporter system (see, for example, Alpert and Siebers (1997) *J. Bacteriol.* 179:1555-1562). The function of repressors such as lacR may be assessed by enzyme activity or growth assays (see, for example, van Rooijen et al. (1993) *Protein Eng.* 6:201-206; van Rooijen and de Vos (1990) *J. Biol. Chem.* 265:18499-18503).

The sequences of the present invention may also modify the ability of an organism to alter the flavor or texture of a food product. Modification of glucose metabolism to produce alternative sugars is one approach that may lead to altered flavor or textural characteristics. Disruption of the lactate dehydrogenase gene with the concomitant expression of genes from the mannitol or sorbitol operons results in the production of mannitol and sorbitol (Hugenholz et al. (2002) supra). Diacetyl production during fermentation results in a butter aroma, which can be enhanced by either disruption of lactate dehydrogenase or overexpression of NADH oxidase in combination with disruption of α-acetolactate decarboxylase (Hugenholz and Kleerebezem, (1999) supra; Hugenholtz et al. (2000) *Appl. Environ. Microbiol.* 66:4112-4114) Alternatively, overproduction of α-acetolactate synthase or acetohydroxy acid synthase with disruption of α-acetolactate decarboxylase has resulted in increased diacetyl production (Swindell et al. (1996) *Appl. Environ. Microbiol.* 62:2641-2643; Platteeuw et al. (1995) *Appl. Environ. Microbiol.* 61:3967-3971). Overexpression of alanine dehydrogenase results in the production of alanine instead of lactic acid, providing a taste-enhancer and sweetener in fermented foods (Hols et al. (1999) *Nat. Biotechnol.* 17:588-592).

Methods for modifying the ability of an organism to produce a modified carbohydrate are also encompassed, comprising introducing at least one nucleotide sequence of the present invention into an organism. Methods for producing modified carbohydrates are also encompassed, and comprise contacting a carbohydrate to be modified with a polypeptide of the present invention. Methods are known in the art for producing modified carbohydrates. See, for example Kim et al. (2001) *Biotechnol. Prog.* 17:208-210.

The sequences of the current invention may also modify the ability of an organism to survive in a food system or the gastrointestinal tract of a mammal, or modify an organism's stability and survival during food processing and storage. For example, increased production of trehalose may result in prolonged freshness and taste of a fermented product (see, for example, www.nutracells.com). Trehalose also may aid in the prevention of diseases that result from protein aggregation or pathological conformations of proteins, such as Creutzfeld-Jacob disease. In plants, accumulation of trehalose leads to protection against environmental stresses such as drought, salt, and cold (see, for example, Jang et al. (2003) *Plant Physiol.* 131:516-524; Penna (2003) *Trends Plant Sci.* 8:355-357; Garg et al. (2002) *Proc. Natl. Acad. Science* 99:15898-15903; Yeo et al. (2000) supra). In addition, plants have been transformed with fructosyltransferase genes, which enabled the plant to accumulate fructans to a high level (van der Meer et al. (1994) *Plant Cell* 6:561-570). In addition to having a role as a carbohydrate reserve, fructans may also provide tolerance to dry and cold conditions (Pontis and del Campillo (1985) "Fructans" in *Biochemistry of Storage Carbohydrates in Green Plants*, Day and Dixon, eds. (London: Academic Press), pp. 810-816; Pilon-Smits et al. (1995) *Plant Physiol.* 107:125-130). The bacterial gene mannitol-1-phosphate dehydrogenase has also been expressed in plants, resulting in the production of mannitol, which is thought to confer beneficial traits including osmoregulation and neutralization of hydroxyl radicals (Tarczynski et al. (1992) supra).

The multidrug transporter sequences of the invention may allow an organism to survive contact with an antimicrobial polypeptide or other toxin. This may be due to an increased ability to transport a drug or toxin out of the cell.

Variants of these nucleotide sequences are also encompassed, such as those that retain or modify the ability to transport a carbohydrate or toxin into or out of a cell, and those that retain or modify the ability to accumulate or utilize a carbohydrate. Methods for making and testing variants of carbohydrate utilization-related or multidrug transporter proteins are well known in the art. See, for example, Poolman et al. (Poolman et al. (1996) *Mol. Microbiol.* 19:911-911), where variants of secondary transport system proteins (mellibiose and lactose) with altered substrate specificities were isolated or constructed and tested. In these mutants, sugar transport is uncoupled from cation symport. See also, for example, Djorovevic et al. (2001) supra, where mutant HPr proteins were constructed with altered regulatory activity; and Adams et al. (Adams et al. (1994) *J. Biol. Chem.* 269: 5666-5672), where cold-sensitive variants of the β-galactosidase gene from *Lactobacillus delbrueckii* subsp. *bulgaricus* were generated and characterized. These mutated genes had a reduced $V_{max}$ at low temperatures and therefore may be useful in preventing the acidification of fermented products during cold storage (Mainzer et al. (1990) "Pathway engineering of *Lactobacillus bulgaricus* for improved yoghurt," in *Yoghurt: Nutritional and Health Properties*, Chandan, ed., (National Yoghurt Association, Virginia, US), pp. 41-55. See, also, Bettenbrock et al. (Bettenbrock et al. (1999) *J. Bacteriol.* 181:225-230), where mutants with modified galactose-specified PTS genes were isolated. See also, van Rooijen et al. (1990) supra, where variants of the lacR repressor were isolated that had no effect on activity. See also Kroetz et al., where polymorphism of the human MDR1 gene was analyzed (Kroetz et al. (2003) *Pharmacogenetics* 13:481-94), and Mitomo et al., where variants of the ABC transporter ABCG2 were analyzed (Mitomo et al. (2003) *Biochem. J.* 373:767-74).

Any of the above modifications may be combined with other metabolic alterations that have been engineered or suggested in lactic acid bacteria. These include, B-vitamin production, such as folate (B11), riboflavin (B2), or cobalamin (B12), the production of polyols, or low-calorie sugars, that could replace sucrose, lactose, glucose, or fructose as sweeteners, the production of tagatose, another sucrose replacement, the production of various exopolysaccharides, blocking glucose metabolism to provide a natural sweetening effect, reduced production of galactose, production of foods with lower levels of α-galactosides such as stachyose and raffinose, and increased production of trehalose, which has preserving properties for foodstuffs and is potentially involved in disease prevention (Hugenholz et al. (2002) supra; van Roojen et al. (1991) *J. Biol. Chem.* 266:7176-7178).

Methods are also provided for eliminating or modifying undesirable carbohydrates from a food or chemical product. The methods comprise contacting the product with a purified polypeptide of the present invention. Methods to assay for the elimination or modification of carbohydrates are well known in the art.

TABLE 1

Carbohydrate Utilization Proteins of the Present Invention

| ORF # | SEQ ID NO: | IDENTITY/FUNCTION |
|---|---|---|
| 452 | 1, 2 | PTS system mannose-specific factor IIAB |
| 877 | 3, 4 | Phosphotransferase system (PTS) lichenan-specific enzyme IIA component |
| 609 | 5, 6 | Beta-glucoside specific transport protein |
| 1479 | 7, 8 | Transcription antiterminator |
| 1574 | 9, 10 | Phospho-beta-glucosidase |
| 1707 | 11, 12 | Beta-glucoside permease IIABC component |
| 725 | 13, 14 | PTS system, beta-glucosides-specific IIABC component |
| 491 | 15, 16 | Phosphotransferase system (PTS) protein, lichenan-specific enzyme IIC component |
| 1369 | 17, 18 | Phosphotransferase system enzyme II |
| 1684 | 19, 20 | Phosphotransferase system IIA component |
| 146 | 21, 22 | PTS system enzyme IIBC component (galactitol/fructose-specific) |
| 227 | 23, 24 | PTS cellobiose-specific component IIC |
| 989 | 25, 26 | PTS cellobiose-specific enzyme IIC |
| 884 | 27, 28 | Cellobiose-specific PTS system IIC component |
| 618 | 29, 30 | PTS system, cellobiose-specific enzyme IIC |
| 606 | 31, 32 | Phosphotransferase system (PTS) arbutin-like enzyme IIBC component |
| 1705 | 33, 34 | Sucrose-specific PTS system IIBC component |
| 1777 | 35, 36 | PTS system protein |
| 500 | 37, 38 | Sucrose operon repressor |
| 502 | 39, 40 | ABC transporter substrate-binding protein |
| 503 | 41, 42 | ABC transporter membrane-spanning permease—sugar transporter |
| 504 | 43, 44 | ABC transporter membrane-spanning permease—sugar transport protein |
| 505 | 45, 46 | Sucrose-6-phosphate hydrolase |
| 506 | 47, 48 | Multiple sugar-binding transport ATP-binding protein |
| 507 | 49, 50 | gtfA protein |
| 1481 | 51, 52 | Ribose ABC transporter(ribose-binding protein) |
| 1482 | 53, 54 | Ribose ABC transporter (permease) |
| 1483 | 55, 56 | Ribose ABC transporter ATP binding protein |
| 1484 | 57, 58 | Ribose permease (RbsD) |
| 1485 | 59, 60 | Ribokinase (RbsK) |
| 1864 | 61, 62 | Maltose ABC transporter permease protein |
| 1865 | 63, 64 | Maltose ABC transporter permease protein |

TABLE 1-continued

Carbohydrate Utilization Proteins of the Present Invention

| ORF # | SEQ ID NO: | IDENTITY/FUNCTION |
|---|---|---|
| 1866 | 65, 66 | Maltose ABC transporter substrate binding protein |
| 1867 | 67, 68 | Multiple sugar-binding transport ATP-binding protein |
| 1944 | 69, 70 | Sugar ABC transporter protein |
| 1945 | 71, 72 | Sugar ABC transporter permease protein |
| 1946 | 73, 74 | Sugar ABC transporter permease protein |
| 45 | 75, 76 | Sugar transporter |
| 552 | 77, 78 | Transporter protein |
| 566 | 79, 80 | Transporter protein |
| 567 | 81, 82 | Drug-efflux transporter |
| 753 | 83, 84 | Transporter protein |
| 1446 | 85, 86 | Drug-export protein |
| 1471 | 87, 88 | Efflux protein |
| 1616 | 89, 90 | Transporter protein |
| 1621 | 91, 92 | Efflux transporter protein |
| 1853 | 93, 94 | Drug-efflux transporter protein |
| 1917 | 95, 96 | Polysaccharide transporter |
| 399 | 97, 98 | Sucrose operon regulatory protein |
| 400 | 99, 100 | Sucrose-6-phosphate hydrolase |
| 401 | 101, 102 | Phosphotransferase system enzyme II |
| 1012 | 103, 104 | Beta-glucoside-specific PTS system IIABC component |
| 1013 | 105, 106 | Trehalose operon transcriptional repressor |
| 1014 | 107, 108 | Dextran glucosidase |
| 1439 | 109, 110 | ABC transporter ATP-binding protein—multiple sugar Transport |
| 1440 | 111, 112 | Multiple sugar-binding transport system permease protein |
| 1441 | 113, 114 | ABC transporter membrane-spanning permease—Multiple sugars |
| 1442 | 115, 116 | Multiple sugar-binding protein precursor |
| 1443 | 117, 118 | Raffinose operon transcriptional regulatory protein |
| 73 | 119, 120 | Carbohydrate-utilization-related |
| 74 | 121, 122 | ABC transporter bacteriocin |
| 75 | 123, 124 | ABC transporter |
| 1131 | 125, 126 | ABC transporter |
| 1132 | 127, 128 | ABC transporter |
| 1357 | 129, 130 | ABC transporter |
| 1358 | 131, 132 | ABC transporter |
| 1679 | 133, 134 | Permease |
| 1680 | 135, 136 | Transporter |
| 1681 | 137, 138 | Carbohydrate-utilization-related |
| 1793 | 139, 140 | Carbohydrate-utilization-related |
| 1794 | 141, 142 | Carbohydrate-utilization-related |
| 1796 | 143, 144 | plnG |
| 1838 | 145, 146 | ABC transporter |
| 1839 | 147, 148 | Permease |
| 1840 | 149, 150 | Regulator |
| 1913 | 151, 152 | ABC transporter |
| 1914 | 153, 154 | ABC transporter |
| 1915 | 155, 156 | Carbohydrate-utilization-related |
| 1938 | 157, 158 | Carbohydrate-utilization-related |
| 1939 | 159, 160 | ABC transporter |
| 453 | 161, 162 | Mannose-specific phosphotransferase system component |
| 454 | 163, 164 | PTS system mannose-specific factor IIAB |
| 455 | 165, 166 | PTS system mannose-specific, factor IIC |
| 456 | 167, 168 | PTS system mannose-specific factor IID |
| 876 | 169, 170 | PTS system enzyme II protein |
| 879 | 171, 172 | Phosphotransferase system sugar-specific EII component |
| 1575 | 173, 174 | PTS system, beta-glucoside-specific enzyme II, ABC component |
| 1463 | 175, 176 | LacS |
| 639 | 177, 177 | ptsH |
| 640 | 179, 180 | ptsI |
| 431 | 181, 182 | ccpA |
| 676 | 183, 184 | ptsK |
| 1778 | 185, 186 | FruK |
| 1779 | 187, 188 | FruR |
| 1433 | 189, 190 | dihydroxyacetone kinase |
| 1434 | 191, 192 | dihydroxyacetone kinase |
| 1436 | 193, 194 | glycerol uptake facilitator |
| 1437 | 195, 196 | gtfAII |

TABLE 1-continued

Carbohydrate Utilization Proteins of the Present Invention

| ORF # | SEQ ID NO: | IDENTITY/FUNCTION |
|---|---|---|
| 1438 | 197, 198 | melA |
| 1457 | 199, 200 | GalM |
| 1458 | 201, 202 | GalT |
| 1459 | 203, 204 | GalK |
| 1460 | 205, 206 | surface protein |
| 1461 | 207, 208 | conserved hypothetical protein |
| 1462 | 209, 210 | LacZ |
| 1467 | 211, 212 | beta-galactosidase |
| 1468 | 213, 214 | beta-galactosidase |
| 1469 | 215, 216 | GalE |
| 1719 | 217, 218 | UDP-glucose phosphorylase |
| 874 | 219, 220 | beta-galactosidase |
| 910 | 221, 222 | L-LDH |
| 1007 | 223, 224 | pyridoxal kinase |
| 1812 | 225, 226 | alpha-glucosidase |
| 1632 | 227, 228 | aldehyde dehydrogenase |
| 1401 | 229, 230 | NADH peroxidase |
| 1974 | 231, 232 | pyruvate oxidase |
| 1102 | 233, 234 | amino acid permease |
| 1783 | 235, 236 | ABC transporter |
| 1879 | 237, 238 | pyrimidine kinase |
| 680 | 239, 240 | glgB |
| 55 | 241, 242 | D-LDH |
| 185 | 243, 244 | phosphoglycerate mutase |
| 271 | 245, 246 | L-LDH |
| 698 | 247, 248 | GPDH |
| 699 | 249, 250 | phosphoglycerate kinase |
| 752 | 251, 252 | glucose 6-phosphate isomerase |
| 889 | 253, 254 | 2-phosphoglycerate dehydratase |
| 956 | 255, 256 | phosphofructokinase |
| 957 | 257, 258 | pyruvate kinase |
| 1599 | 259, 260 | fructose bisphosphate aldolase |
| 1641 | 261, 262 | glycerol 3-phosphate ABC transporter |
| 452 | 263, 264 | Mannose; PTS system mannose-specific factor IIAB |
| 1479 | 265, 266 | beta-glucoside; transcription antiterminator |
| 725 | 267, 268 | beta-glucoside; PTS system, beta-glucosides-specific IIABC component |
| 1369 | 269, 270 | Cellobiose; phosphotransferase system enzyme II |
| 227 | 271, 272 | Cellobiose; PTS cellobiose-specific component II |
| 502 | 273, 274 | sugar transporter; ABC transporter substrate-binding protein |
| 507 | 275, 276 | GtfA |
| 1483 | 277, 278 | rbsA; ribose ABC transporter ATP binding protein |
| 1484 | 279, 280 | ribose permease RbsD |
| 552 | 281, 282 | multidrug transporter |
| 567 | 283, 284 | multidrug transporter |
| 1471 | 285, 286 | multidrug transporter |
| 1853 | 287, 288 | multidrug transporter |
| 1012 | 289, 290 | treB; beta-glucoside; beta-glucoside-specific PTS system IIABC component |
| 1014 | 291, 292 | treC |
| 1440 | 293, 294 | msmG |
| 1442 | 295, 296 | msmE |
| 1132 | 297, 298 | ABC transporter |
| 1358 | 299, 300 | ABC transporter |
| 1838 | 301, 302 | ABC transporter |
| 1840 | 303, 304 | transcriptional regulator (TetR/AcrR family) |
| 1913 | 305, 306 | ABC transporter |
| 1938 | 307, 308 | |
| 164 | 309, 310 | multidrug transporter |
| 251 | 311, 312 | multidrug transporter |
| 252 | 313, 314 | multidrug transporter |
| 253 | 315, 316 | multidrug transporter |
| 1062 | 317, 318 | multidrug transporter |
| 597 | 319, 320 | ABC multidrug transporter |
| 1854 | 321, 322 | multidrug transporter |

The following examples are offered by way of illustration and not by way of limitation.

EXAMPLE 1

Gapped BlastP Results for Amino Acid Sequences

A Gapped BlastP sequence alignment showed that SEQ ID NO:2 (144 amino acids) has about 61% identity from amino acids 1-140 with a protein from *Listeria innocua* that is homologous to a PTS system mannose-specific factor IIAB (Accession Nos. NP_469488.1; NC_003212), about 60% identity from amino acids 1-140 with a protein from *Listeria monocytogenes* that is homologous to a PTS system mannose-specific factor IIAB (Accession Nos. NP_463629.1; NC_003210), about 63% identity from amino acids 1-139 with a protein from *Clostridium acetobutylicum* that is a mannose-specific phosphotransferase system component IIAB (Accession Nos. NP_149230.1; NC_001988), about 62% identity from amino acids 1-139 with a protein from *Clostridium perfringens* that is a PTS system protein (Accession Nos. NP_561737.1; NC_003366), and about 50% identity from amino acids 2-141 with a protein from *Streptococcus pyogenes* that is a mannose-specific phosphotransferase system component IIAB (Accession Nos. NP_269761.1; NC_002737).

A Gapped BlastP sequence alignment showed that SEQ ID NO:4 (123 amino acids) has about 60% identity from amino acids 20-109 with a protein from *Listeria innocua* that is homologous to a phosphotransferase system (PTS) lichenan-specific enzyme IIA component (Accession Nos. NP_471165.1; NC_003212), about 57% identity from amino acids 20-110 with a protein from *Listeria innocua* that is homologous to a cellobiose phosphotransferase enzyme IIA component (Accession Nos. NP_472161.1; NC_003212), about 46% identity from amino acids 1-112 with a protein from *Lactococcus lactis* subsp. *lactis* that is a cellobiose-specific PTS system IIA component (EC 2.7.1.69) (Accession Nos. NP_266570.1; NC_002662), about 44% identity from amino acids 9-112 with a protein from *Bacillus halodurans* that is a PTS system, cellobiose-specific enzyme IIA component (Accession Nos. NP_241776.1; NC_002570), and about 51% identity from amino acids 16-112 with a protein from *Streptococcus pyogenes* that is homologous to a PTS enzyme III (Accession Nos. NP_607437.1; NC_003485).

A Gapped BlastP sequence alignment showed that SEQ ID NO:6 (161 amino acids) has about 53% identity from amino acids 6-143 with a protein from *Enterococcus faecium* that is a beta-glucoside specific transport protein (BglS) (Accession Nos. gb|AAD28228.1; AF121254), about 48% identity from amino acids 13-159 with a protein from *Streptococcus pneumoniae* that is a PTS system, IIABC component (Accession Nos. NP_345256.1; NC_003028), about 48% identity from amino acids 13-159 with a protein from *Streptococcus pneumoniae* that is a PTS glucose-specific enzyme IIABC component (Accession Nos. NP_358262.1; NC_003098), about 46% identity from amino acids 13-159 with a protein from *Streptococcus pyogenes* that is homologous to a PTS system, enzyme IIA component (Accession Nos. NP_608025.1; NC_003485), and about 46% identity from amino acids 13-159 with a protein from *Streptococcus pyogenes* that is homologous to a PTS system, enzyme IIA component (Accession Nos. NP_269950.1; NC_002737).

A Gapped BlastP sequence alignment showed that SEQ ID NO:8 (291 amino acids) has about 36% identity from amino acids 11-282 with a protein from *Bacillus subtilis* that is a transcription antiterminator (licT) (Accession No. sp|P39805|LICT_BACSU), about 36% identity from amino acids 11-282 with a protein from *Bacillus subtilis* that is a transcriptional antiterminator (BglG family) (Accession Nos. NP_391787.1; NC_000964), about 37% identity from amino acids 11-282 with a protein from *Escherichia coli* that is involved in positive regulation of the bgl operon (Accession Nos. NP_418179.1; NC_000913), about 33% identity from amino acids 11-282 with a protein from *Erwinia chrysanthemi* that is a beta-glucoside operon antiterminator (Accession No. sp|P26211|ARBG_ERWCH), and about 34% identity from amino acids 9-288 with a protein from *Clostridium acetobutylicum* that is a transcriptional antiterminator (licT) (Accession Nos. NP_347062.1; NC_003030).

A Gapped BlastP sequence alignment showed that SEQ ID NO:10 (480 amino acids) has about 59% identity from amino acids 8-473 with a protein from *Listeria monocytogenes* that is homologous to a phospho-beta-glucosidase (Accession Nos. NP_463849.1; NC_003210), about 58% identity from amino acids 8-473 with a protein from *Listeria innocua* that is homologous to a phospho-beta-glucosidase (Accession Nos. NP_469689.1; NC_003212), about 57% identity from amino acids 7-473 with a protein from *Clostridium acetobutylicum* that is a 6-phospho-beta-glucosidase (NP_347379.1; NC_003030), about 57% identity from amino acids 8-473 with a protein from *Clostridium longisporum* that is a 6-phospho-beta-glucosidase (Accession No. sp|Q46130|ABGA_CLOLO), and about 55% identity from amino acids 1-473 with a protein from *Bacillus subtilis* that is a beta-glucosidase (Accession Nos. NP_391805.1; NC_000964).

A Gapped BlastP sequence alignment showed that SEQ ID NO:12 (625 amino acids) has about 38% identity from amino acids 1-624 with a protein from *Streptococcus pyogenes* that is a beta-glucoside permease IIABC component (Accession Nos. NP_268836.1; NC_002737), about 38% identity from amino acids 1-624 with a protein from *Streptococcus pyogenes* that is a beta-glucoside permease IIABC component (Accession Nos. NP_606826.1; NC_003485), about 38% identity from amino acids 1-605 with a protein from *Streptococcus pneumoniae* that is a phosphotransferase system sugar-specific EII component (Accession Nos. NP_358099.1; NC_003098), about 38% identity from amino acids 1-605 with a protein from *Streptococcus pneumoniae* that is a PTS system, beta-glucosides-specific IIABC component (Accession Nos. NP_345091.1; NC_003028), and about 38% identity from amino acids 1-622 with a protein from *Bacillus halodurans* that is a PTS system, beta-glucoside-specific enzyme IIABC component (Accession Nos. NP_241162.1; NC_002570).

A Gapped BlastP sequence alignment showed that SEQ ID NO:14 (675 amino acids) has about 50% identity from amino acids 17-648 with a protein from *Clostridium acetobutylicum* that is a PTS system, beta-glucosides-specific IIABC component (Accession Nos. NP_348035.1; NC_003030), about 50% identity from amino acids 17-656 with a protein from *Bacillus halodurans* that is a PTS system, beta-glucoside-specific enzyme IIABC (Accession Nos. NP_241461.1; NC_002570), about 50% identity from amino acids 17-656 with a protein from *Listeria monocytogenes* that is homologous to a PTS system, beta-glucosides specific enzyme IIABC (Accession Nos. NP_463560.1; NC_003210), about 48% identity from amino acids 17-654 with a protein from *Clostridium longisporum* that is a PTS-dependent enzyme II (Accession Nos. gb|AAC05713.1; L49336), and 48% identity from amino acids 13-654 with a protein from *Streptococcus mutans* that is a beta-glucoside-specific EII permease (Accession Nos. gb|AAF89975.1; AF206272).

A Gapped BlastP sequence alignment showed that SEQ ID NO:16 (445 amino acids) has about 41% identity from amino acids 10-443 with a protein from *Bacillus subtilis* that is a phosphotransferase system (PTS) protein, lichenan-specific enzyme IIC component (Accession Nos. NP_391737.1; NC_000964), about 42% identity from amino acids 14-442 with a protein from *Bacillus subtilis* that is homologous to a PTS system IIBC component (ywbA) (Accession No. sp|P39584|YWBA_BACSU), about 41% identity from amino acids 14-441 with a protein from *Bacillus stearothermophilus* that is a cellobiose phosphotransferase enzyme IIC component (Accession No. sp|Q45400|PTCC_BACST), about 41% identity from amino acids 12-441 with a protein from *Streptococcus pneumoniae* that is a phosphotransferase system sugar-specific EII component (Accession Nos. NP_358015.1; NC_003098), and 40% identity from amino acids 12-441 with a protein from *Streptococcus pneumoniae* that is a PTS system, cellobiose-specific IIC component (Accession Nos. NP_344993.1; NC_003028).

A Gapped BlastP sequence alignment showed that SEQ ID NO:18 (422 amino acids) has about 34% identity from amino acids 9-417 with a protein from *Bacillus subtilis* that is homologous to a phosphotransferase system enzyme II (Accession Nos. NP_391718.1; NC_000964), about 33% identity from amino acids 17-414 with a protein from *Bacillus subtilis* that is a phosphotransferase system (PTS) lichenan-specific enzyme IIC component (Accession Nos. NP_391737.1; NC_000964), about 34% identity from amino acids 10-417 with a protein from *Bacillus stearothermophilus* that is a cellobiose phosphotransferase enzyme IIC component (Accession No. sp|Q45400|PTCC_BACST), about 33% identity from amino acids 9-414 with a protein from *Listeria innocua* that is homologous to a PTS system, cellobiose-specific IIC component (Accession Nos. NP_470241.1; NC_003212), and 31% identity from amino acids 11-415 with a protein from *Borrelia burgdorferi* that is a PTS system, cellobiose-specific IIC component (celB) (Accession Nos. NP_046990.1; NC_001903).

A Gapped BlastP sequence alignment showed that SEQ ID NO:20 (130 amino acids) has about 33% identity from amino acids 3-124 with a protein from *Brucella melitensis* that is a phosphotransferase system IIA component (Accession Nos. NP_540949.1; NC_003317), about 32% identity from amino acids 2-102 with a protein from *Lactobacillus curvatus* that is an EIIA-mannose protein (Accession Nos. gb|AAB04153.1; U28163), about 32% identity from amino acids 3-96 with a protein from *Clostridium perfringens* that is homologous to a PTS system protein (Accession Nos. NP_563545.1; NC_003366), about 25% identity from amino acids 3-123 with a protein from *Clostridium perfringens* that is homologous to a PTS system protein (Accession Nos. NP_561737.1; NC_003366), and 25% identity from amino acids 3-123 with a protein from *Clostridium acetobutylicum* that is a mannose-specific phosphotransferase system component IIAB (Accession Nos. NP_149230.1; NC_001988).

A Gapped BlastP sequence alignment showed that SEQ ID NO:22 (162 amino acids) has about 38% identity from amino acids 8-159 with a protein from *Clostridium acetobutylicum* that is a PTS system enzyme IIBC component (galactitol/fructose-specific) (Accession Nos. NP_349560.1; NC_003030), about 36% identity from amino acids 7-158 with a protein from *Streptococcus pneumoniae* that is a phosphotransferase system sugar-specific EII component (Accession Nos. NP_358156.1; NC_003098), about 36% identity from amino acids 7-158 with a protein from *Streptococcus pneumoniae* that is homologous to a PTS system IIA component (Accession Nos. NP_345152.1; NC_003028), about 38% identity from amino acids 20-134 with a protein from *Streptococcus agalactiae* that is a GatA protein (Accession Nos. gb|AAG09977.1; AF248038), and 33% identity from amino acids 16-159 with a protein from *Bacillus halodurans* that is a PTS system, galactitol-specific enzyme IIA component (Accession Nos. NP_241058.1; NC_002570).

A Gapped BlastP sequence alignment showed that SEQ ID NO:24 (466 amino acids) has about 47% identity from amino acids 30-461 with a protein from *Clostridium acetobutylicum* that is a PTS cellobiose-specific component IIC (Accession NP_347026.1; NC_003030), about 45% identity from amino acids 26-465 with a protein from *Lactococcus lactis* subsp. *lactis* that is a cellobiose-specific PTS system IIC component (EC 2.7.1.69) (Accession Nos. NP_266974.1; NC_002662), about 46% identity from amino acids 82-465 with a protein from *Lactococcus lactis* subsp. *lactis* that is a cellobiose-specific PTS system IIC component (EC 2.7.1.69) (Accession Nos. NP_266572.1; NC_002662), about 41% identity from amino acids 34-466 with a protein from *Streptococcus pyogenes* that is homologous to a PTS system, enzyme IIC component (Accession Nos. NP_269994.1; NC_002737), and 40% identity from amino acids 34-466 with a protein from *Streptococcus pyogenes* that is homologous to a PTS system, enzyme IIC component (Accession Nos. NP_608069.1; NC_003485).

A Gapped BlastP sequence alignment showed that SEQ ID NO:26 (428 amino acids) has about 28% identity from amino acids 25-420 with a protein from *Listeria innocua* that is homologous to a PTS cellobiose-specific enzyme IIC (Accession NP_472233.1; NC_003212), about 27% identity from amino acids 115-415 with a protein from *Lactobacillus casei* that is a LacE protein (Accession Nos. emb|CAB02556.1; Z80834), about 26% identity from amino acids 137-425 with a protein from *Listeria innocua* that is homologous to a PTS system, cellobiose-specific enzyme IIC (Accession Nos. NP_472184.1; NC_003212), about 26% identity from amino acids 137-425 with a protein from *Listeria monocytogenes* that is homologous to a PTS system, cellobiose-specific enzyme IIC (Accession Nos. NP_466230.1; NC_003210), and 26% identity from amino acids 115-415 with a protein from *Lactobacillus casei* that is a phosphotransferase system enzyme II (EC 2.7.1.69) (Accession No. pir||B23697).

A Gapped BlastP sequence alignment showed that SEQ ID NO:28 (475 amino acids) has about 57% identity from amino acids 10-471 with a protein from *Lactococcus lactis* subsp. *lactis* that is a cellobiose-specific PTS system IIC component (EC 2.7.1.69) (Accession Nos. NP_266974.1; NC_002662), about 45% identity from amino acids 71-475 with a protein from *Lactococcus lactis* subsp. *lactis* that is a cellobiose-specific PTS system IIC component (EC 2.7.1.69) (Accession Nos. NP_266572.1; NC_002662), about 42% identity from amino acids 13-470 with a protein from *Clostridium acetobutylicum* that is a PTS cellobiose-specific component IIC (Accession Nos. NP_347026.1; NC_003030), about 41% identity from amino acids 17-468 with a protein from *Streptococcus pyogenes* that is homologous to a PTS system, enzyme IIC component (Accession Nos. NP_269994.1; NC_002737), and 41% identity from amino acids 17-468 with a protein from *Streptococcus pyogenes* that is homologous to a PTS system, enzyme IIC component (Accession Nos. NP_608069.1|(NC_003485).

A Gapped BlastP sequence alignment showed that SEQ ID NO:30 (441 amino acids) has about 46% identity from amino acids 1-428 with a protein from *Listeria innocua* that is homologous to a PTS system, cellobiose-specific enzyme IIC (Accession Nos. NP_472184.1; NC_003212), about 46% identity from amino acids 1-428 with a protein from *Listeria monocytogenes* that is homologous to a PTS system, cellobiose-specific enzyme IIC (Accession Nos. NP_466230.1; NC_003210), about 39% identity from amino acids 10-427 with a protein from *Streptococcus pyogenes* that is homologous to a PTS system IIC component (Accession Nos. NP_607435.1; NC_003485), about 36% identity from amino acids 1-428 with a protein from *Lactococcus lactis* subsp. *lactis* that is a cellobiose-specific PTS system IIC component (EC 2.7.1.69) (Accession Nos. NP_266330.1; NC_002662), and 31% identity from amino acids 1-421 with a protein from *Listeria monocytogenes* that is homologous to a cellobiose phosphotransferase enzyme IIC component (Accession Nos. NP_466206.1; NC_003210).

A Gapped BlastP sequence alignment showed that SEQ ID NO:32 (626 amino acids) has about 54% identity from amino acids 1-532 with a protein from *Bacillus subtilis* that is a phosphotransferase system (PTS) arbutin-like enzyme IIBC component (Accession Nos. NP_388701.1; NC_000964), about 51% identity from amino acids 2-530 with a protein from *Clostridium perfringens* that is a PTS arbutin-like enzyme IIBC component (Accession Nos. NP_561112.1; NC_003366), about 52% identity from amino acids 1-533 with a protein from *Fusobacterium mortiferum* that is a PTS protein EII (Accession Nos. gb|AAB63014.2; U81185), about 51% identity from amino acids 1-533 with a protein from *Clostridium acetobutylicum* that is a MalP protein (Accession Nos. gb|AAK69555.1; AF290982), and 51% identity from amino acids 1-533 with a protein from *Clostridium acetobutylicum* that is a PTS system, arbutin-like IIBC component (Accession Nos. NP_347171.1; NC_003030).

A Gapped BlastP sequence alignment showed that SEQ ID NO:34 (663 amino acids) has about 58% identity from amino acids 1-456 with a protein from *Lactococcus lactis* subsp. *lactis* that is a sucrose-specific PTS system IIBC component (EC2.7.1.69) (Accession Nos. NP_267287.1; NC_002662), about 54% identity from amino acids 5-471 with a protein from *Staphylococcus aureus* subsp. *aureus* that is homologous to a sucrose phosphotransferase enzyme II (Accession Nos. NP_373429.1; NC_002745), about 46% identity from amino acids 5-472 with a protein from *Bacillus halodurans* that is a PTS system, sucrose phosphotransferase enzyme IIBC component (Accession Nos. NP_244441.1; NC_002570), about 39% identity from amino acids 4-468 with a protein from *Salmonella enterica* subsp. *enterica* serovar *Typhi* that is homologous to a PTS system IIBC component (Accession Nos. NP_457099.1; NC_003198), and 39% identity from amino acids 4-468 with a protein from *Salmonella typhimurium* that is homologous to a phosphotransferase system IIB component (Accession Nos. NP_461505.1; NC_003197).

A Gapped BlastP sequence alignment showed that SEQ ID NO:36 (665 amino acids) has about 44% identity from amino acids 1-661 with a protein from *Clostridium perfringens* that is a PTS system protein (Accession Nos. NP_561500.1; NC_003366), about 46% identity from amino acids 1-657 with a protein from *Streptococcus pyogenes* that is homologous to a fructose-specific enzyme II, PTS system BC component (Accession Nos. NP_269062.1; NC_002737), about 46% identity from amino acids 1-657 with a protein from *Streptococcus pyogenes* that is homologous to a fructose-specific enzyme II, PTS system BC component (Accession Nos. NP_607065.1; NC_003485), about 45% identity from amino acids 1-657 with a protein from *Lactococcus lactis* subsp. *lactis* that is a fructose-specific PTS system enzyme IIBC component (EC 2.7.1.69) (Accession Nos. NP_267115.1; NC_002662), and 43% identity from amino acids 1-660 with a protein from *Bacillus halodurans* that is a PTS system, fructose-specific enzyme IIBC component (Accession Nos. NP_241694.1; NC_002570).

A Gapped BlastP sequence alignment showed that SEQ ID NO:38 (334 amino acids) has about 48% identity from amino acids 4-334 with a protein from *Streptococcus pneumoniae* that is a sucrose operon repressor (Scr operon regulatory protein) (Accession Nos. NP_359213.1; NC_003098), about 46% identity from amino acids 4-334 with a protein from *Streptococcus pneumoniae* that is a sugar-binding transcriptional regulator in the LacI family (Accession Nos. NP_346232.1; NC_003028), about 35% identity from amino acids 13-332 with a protein from *Pediococcus pentosaceus* that is a sucrose operon repressor (Scr operon regulatory protein) (Accession No. sp|P43472|SCRR_PEDPE), about 35% identity from amino acids 10-334 with a protein from *Bacillus halodurans* that is a transcriptional repressor of the ribose operon (Accession Nos. NP_244594.1; NC_002570), and 35% identity from amino acids 10-332 with a protein from *Streptococcus pneumoniae* that is a sucrose operon repressor (Accession Nos. NP_346162.1; NC_003028).

A Gapped BlastP sequence alignment showed that SEQ ID NO:40 (415 amino acids) has about 50% identity from amino acids 3-415 with a protein from *Streptococcus pneumoniae* that is an ABC transporter substrate-binding protein (Accession Nos. NP_359212.1; NC_003098), about 27% identity from amino acids 19-389 with a protein from *Agrobacterium tumefaciens* that is a sugar binding protein (Accession Nos. NP_535638.1; NC_003306), about 25% identity from amino acids 11-396 with a protein from *Nostoc* sp. PCC 7120 that is an ABC transporter sugar binding protein (Accession Nos. NP_488317.1; NC_003272), about 26% identity from amino acids 76-353 with a protein from *Streptomyces coelicolor* that is homologous to a sugar transport sugar binding protein (Accession Nos. emb|CAB95275.1; AL359779), and 26% identity from amino acids 1-324 with a protein from *Listeria innocua* that is homologous to a sugar ABC transporter, periplasmic sugar-binding protein (Accession Nos. NP_470104.1; NC_003212).

A Gapped BlastP sequence alignment showed that SEQ ID NO:42 (294 amino acids) has about 56% identity from amino acids 10-285 with a protein from *Streptococcus pneumoniae* that is an ABC transporter membrane-spanning permease—sugar transporter (Accession Nos. NP_359211.1; NC_003098), about 38% identity from amino acids 7-285 with a protein from *Listeria monocytogenes* that is homologous to a sugar ABC transporter permease protein (Accession Nos. NP_464293.1; NC_003210), about 38% identity from amino acids 7-285 with a protein from *Listeria innocua* that is homologous to a sugar ABC transporter permease protein (Accession Nos. NP_470102.1; NC_003212), about 36% identity from amino acids 12-286 with a protein from *Synechocystis* sp. PCC 6803 that is a lactose transport system permease protein (LacF) (Accession Nos. NP_440703.1; NC_000911), and 36% identity from amino acids 11-281 with a protein from *Xylella fastidiosa* that is a ABC transporter sugar permease (Accession Nos. NP_299726.1; NC_002488).

A Gapped BlastP sequence alignment showed that SEQ ID NO:44 (285 amino acids) has about 59% identity from amino acids 12-285 with a protein from *Streptococcus pneumoniae* that is an ABC transporter membrane-spanning permease—sugar transport protein (Accession Nos. NP_359210.1; NC_003098), about 32% identity from amino acids 30-281 with a protein from *Agrobacterium tumefaciens* (Accession Nos. NP_356672.1; NC_003063), about 32% identity from amino acids 30-281 with a protein from *Agrobacterium tumefaciens* that is an ABC transporter, membrane spanning protein [sugar] (Accession Nos. NP_534455.1; NC_003305), about 33% identity from amino acids 10-281 with a protein from *Listeria monocytogenes* that is homologous to a sugar ABC transporter, permease protein (Accession Nos. NP_463711.1; NC_003210), and 34% identity from amino acids 13-281 with a protein from *Listeria innocua* that is homologous to a sugar ABC transporter, permease protein (Accession Nos. NP_469564.1; NC_003212).

A Gapped BlastP sequence alignment showed that SEQ ID NO:46 (430 amino acids) has about 36% identity from amino acids 2-429 with a protein from *Streptococcus pneumoniae* that is a sucrose-6-phosphate hydrolase (Accession Nos. NP_359209.1; NC_003098), about 36% identity from amino acids 2-429 with a protein from *Streptococcus pneumoniae* that is homologous to a sucrose-6-phosphate hydrolase (Accession Nos. NP_346228.1; NC_003028), about 36% identity from amino acids 18-373 with a protein from *Thermotoga maritima* that is a beta-fructosidase (Accession Nos. NP_229215.1; NC_000853), about 31% identity from amino acids 21-405 with a protein from *Zymomonas mobilis* that is a beta-fructofuranosidase (EC 3.2.1.26) (Accession No. pir||JU0460), and 35% identity from amino acids 21-362 with a protein from *Escherichia coli* that is a sucrose-6 phosphate hydrolase (Accession Nos. NP_311270.1; NC_002695).

A Gapped BlastP sequence alignment showed that SEQ ID NO:48 (368 amino acids) has about 65% identity from amino acids 1-366 with a protein from *Streptococcus mutans* that is a multiple sugar-binding transport ATP-binding protein (msmK) (Accession No. sp|Q00752|MSMK_STRMU), about 65% identity from amino acids 1-366 with a protein from *Streptococcus pyogenes* that is a multiple sugar-binding ABC transport system (ATP-binding protein) (Accession Nos. NP_269942.1; NC_002737), about 66% identity from amino acids 1-367 with a protein from *Streptococcus pneumoniae* that is an ABC transporter ATP-binding protein—multiple sugar transport (Accession Nos. NP_359030.1; NC_003098), about 65% identity from amino acids 1-366 with a protein from *Streptococcus pyogenes* that is a multiple sugar-binding ABC transport system (ATP-binding protein) (Accession Nos. NP_608016.1; NC_003485), and 66% identity from amino acids 1-367 with a protein from *Streptococcus pneumoniae* that is a sugar ABC transporter, ATP-binding protein (Accession Nos. NP_346026.1; NC_003028).

A Gapped BlastP sequence alignment showed that SEQ ID NO:50 (490 amino acids) has about 63% identity from amino acids 11-489 with a protein from *Streptococcus mutans* that is a gtfA protein (Accession No. pir||BWSOGM), about 63% identity from amino acids 11-490 with a protein from *Streptococcus mutans* that is a sucrose phosphorylase (EC 2.4.1.7) (Accession No. pir||A27626), about 63% identity from amino acids 11-489 with a protein from *Streptococcus mutans* that is a sucrose phosphorylase (sucrose glucosyltransferase) (Accession No. sp|P10249|SUCP_STRMU), about 63% identity from amino acids 11-484 with a protein from *Streptococcus pneumoniae* that is a dextransucrase (sucrose 6-glucosyltransferase) (Accession Nos. NP_359301.1; NC_003098), and 63% identity from amino acids 11-484 with a protein from *Streptococcus pneumoniae* that is a sucrose phosphorylase (Accession Nos. NP_346325.1; NC_003028).

A Gapped BlastP sequence alignment showed that SEQ ID NO:52 (328 amino acids) has about 55% identity from amino acids 47-316 with a protein from *Bacillus subtilis* that is a ribose ABC transporter (ribose-binding protein) (Accession Nos. NP_391477.1; NC_000964), about 45% identity from amino acids 5-323 with a protein from *Lactococcus lactis* subsp. *lactis* that is a ribose ABC transporter substrate binding protein (Accession Nos. NP_267791.1; NC_002662), about 42% identity from amino acids 4-278 with a protein from *Tetragenococcus halophilus* that is a ribose binding protein (Accession Nos. dbj|BAA31869.1; AB009593), about 39% identity from amino acids 15-316 with a protein from *Bacillus halodurans* that is a ribose ABC transporter (ribose-binding protein) (Accession Nos. NP_244599.1; NC_002570), and 42% identity from amino acids 4-315 with a protein from *Pasteurella multocida* that is an RbsB protein (Accession Nos. NP_245090.1; NC_002663).

A Gapped BlastP sequence alignment showed that SEQ ID NO:54 (285 amino acids) has about 60% identity from amino acids 1-277 with a protein from *Bacillus subtilis* that is a ribose ABC transporter (permease) (Accession Nos. NP_391476.1; NC_000964), about 59% identity from amino acids 1-277 with a protein from *Bacillus subtilis* that is a ribose transport system permease protein (rbcS) (Accession No. sp|P36948|RBSC_BACSU), about 57% identity from amino acids 4-277 with a protein from *Bacillus halodurans* that is a ribose ABC transporter (permease) (Accession Nos. NP_244598.1; NC_002570), about 58% identity from amino acids 4-277 with a protein from *Lactococcus lactis* subsp. *lactis* that is a ribose ABC transporter permease protein (Accession Nos. NP_267792.1; NC_002662), and 54% identity from amino acids 4-278 with a protein from *Haemophilus influenzae* that is a D-ribose ABC transporter, permease protein (rbsC) (Accession Nos. NP_438661.1; NC_000907).

A Gapped BlastP sequence alignment showed that SEQ ID NO:56 (496 amino acids) has about 59% identity from amino acids 5-496 with a protein from *Lactococcus lactis* subsp. *lactis* that is a ribose ABC transporter ATP binding protein (Accession Nos. NP_267793.1; NC_002662), about 57% identity from amino acids 5-496 with a protein from *Bacillus subtilis* that is a ribose ABC transporter (ATP-binding protein) (Accession Nos. NP_391475.1; NC_000964), about 51% identity from amino acids 5-496 with a protein from *Bacillus subtilis* that is an ATP binding protein (Accession No. pir||I40465), about 49% identity from amino acids 5-495 with a protein from *Bacillus halodurans* that is a ribose ABC transporter (ATP-binding protein) (Accession Nos. NP_244597.1; NC_002570), and 45% identity from amino acids 7-494 with a protein from *Agrobacterium tumefaciens* that is an ABC transporter, nucleotide binding/ATPase protein [ribose] (Accession Nos. NP_533484.1; NC_003304).

A Gapped BlastP sequence alignment showed that SEQ ID NO:58 (134 amino acids) has about 58% identity from amino acids 4-134 with a protein from *Lactobacillus sakei* that is a ribose permease (RbsD) (Accession Nos. gb|AAD34337.1; AF115391), about 51% identity from amino acids 4-134 with a protein from *Clostridium perfringens* that is homologous to a ribose ABC transporter (Accession Nos. NP_562547.1; NC_003366), about 50% identity from amino acids 4-132 with a protein from *Lactococcus lactis* subsp. *lactis* that is a ribose ABC transporter permease protein (Accession Nos. NP_267794.1; NC_002662), about 45% identity from amino acids 4-134 with a protein from *Bacillus halodurans* that is a ribose ABC transporter (permease) (Accession Nos. NP_244596.1; NC_002570), and 51% identity from amino acids 4-134 with a protein from *Staphylococcus aureus* subsp. *aureus* that is a ribose permease (Accession Nos. NP_370793.1; NC_002758).

A Gapped BlastP sequence alignment showed that SEQ ID NO:60 (308 amino acids) has about 51% identity from amino acids 4-301 with a protein from *Lactobacillus sakei* that is a ribokinase (RbsK) (Accession Nos. gb|AAD34338.1; AF115391), about 48% identity from amino acids 1-303 with a protein from *Staphylococcus aureus* subsp. *aureus* that is homologous to a ribokinase (Accession Nos. NP_370792.1; NC_002758), about 45% identity from amino acids 3-305 with a protein from *Clostridium perfringens* that is a ribokinase (Accession Nos. NP_562548.1; NC_003366), about 41% identity from amino acids 1-299 with a protein from *Haemophilus influenzae* that is a ribokinase (RbsK) (Accession Nos. NP_438663.1; NC_000907), and 38% identity from amino acids 2-300 with a protein from *Yersinia pestis* that is a ribokinase (Accession Nos. NP_403674.1; NC_003143).

A Gapped BlastP sequence alignment showed that SEQ ID NO:62 (285 amino acids) has about 63% identity from amino acids 1-285 with a protein from *Lactococcus lactis* subsp. *lactis* that is a maltose ABC transporter permease protein (Accession Nos. NP_267841.1; NC_002662), about 54% identity from amino acids 6-284 with a protein from *Streptococcus pyogenes* that is homologous to a maltose/maltodextrin ABC transport system protein (permease) (Accession Nos. NP_269423.1; NC_002737), about 38% identity from amino acids 12-284 with a protein from *Klebsiella oxytoca* that is homologous to a malG protein (Accession No. pir||S63616), about 39% identity from amino acids 9-285 with a protein from *Bacillus halodurans* that is a maltose/maltodextrin transport system (permease) (Accession Nos. NP_243790.1; NC_002570), and 36% identity from amino acids 7-285 with a protein from *Bacillus subtilis* that is homologous to a maltodextrin transport system permease (Accession Nos. NP_391294.1; NC_000964).

A Gapped BlastP sequence alignment showed that SEQ ID NO:64 (452 amino acids) has about 63% identity from amino acids 1-452 with a protein from *Lactococcus lactis* subsp. *lactis* that is a maltose ABC transporter permease protein (Accession Nos. NP_267840.1; NC_002662), about 52% identity from amino acids 3-452 with a protein from *Streptococcus pyogenes* that is homologous to a maltose/maltodextrin ABC transport system protein (permease) (Accession Nos. NP_269422.1; NC_002737), about 52% identity from amino acids 3-452 with a protein from *Streptococcus pyogenes* that is homologous to a maltose/maltodextrin ABC transport system (permease) (Accession Nos. NP_607422.1; NC_003485), about 34% identity from amino acids 28-451 with a protein from *Klebsiella oxytoca* that is homologous to a malF protein (Accession No. pir||S63615), and 33% identity from amino acids 23-451 with a protein from *Bacillus halodurans* that is a maltose/maltodextrin transport system permease (Accession Nos. NP_243791.1; NC_002570).

A Gapped BlastP sequence alignment showed that SEQ ID NO:66 (408 amino acids) has about 49% identity from amino acids 1-407 with a protein from *Lactococcus lactis* subsp. *lactis* that is a maltose ABC transporter substrate binding protein (Accession Nos. NP 267839.1; NC_002662), about 37% identity from amino acids 1-405 with a protein from *Streptococcus pyogenes* that is homologous to a maltose/maltodextrin-binding protein (Accession Nos. NP_607421.1; NC_003485), about 36% identity from amino acids 1-405 with a protein from *Streptococcus pyogenes* that is homologous to a maltose/maltodextrin-binding protein (Accession Nos. NP_269421.1; NC_002737), about 27% identity from amino acids 1-393 with a protein from *Listeria innocua* that is homologous to a maltose/maltodextrin ABC-transporter (binding protein) (Accession Nos.

NP_471563.1; NC_003212), and 26% identity from amino acids 1-403 with a protein from *Bacillus subtilis* that is homologous to a maltose/maltodextrin-binding protein (Accession Nos. NP_391296.1; NC_000964).

A Gapped BlastP sequence alignment showed that SEQ ID NO:68 (368 amino acids) has about 64% identity from amino acids 1-366 with a protein from *Streptococcus mutans* that is a multiple sugar-binding transport ATP-binding protein (msmK) (Accession No. sp|Q00752|MSMK_STRMU), about 64% identity from amino acids 1-366 with a protein from *Streptococcus pyogenes* that is a multiple sugar-binding ABC transport system (ATP-binding) protein (Accession Nos. NP_269942.1; NC_002737), about 64% identity from amino acids 1-366 with a protein from *Streptococcus pyogenes* that is a multiple sugar-binding ABC transport system (ATP-binding) protein (Accession Nos. NP_608016.1; NC_003485), about 64% identity from amino acids 1-366 with a protein from *Streptococcus pneumoniae* that is an ABC transporter ATP-binding protein—multiple sugar transport (Accession Nos. NP_359030.1; NC_003098), and 62% identity from amino acids 1-368 with a protein from *Lactococcus lactis* subsp. *lactis* that is a multiple sugar ABC transporter ATP-binding protein (Accession Nos. NP_266577.1; NC_002662).

A Gapped BlastP sequence alignment showed that SEQ ID NO:70 (512 amino acids) has about 60% identity from amino acids 1-510 with a protein from *Streptococcus pyogenes* that is homologous to a sugar ABC transporter (ATP-binding protein) (Accession Nos. NP_269365.1; NC_002737), about 60% identity from amino acids 1-510 with a protein from *Streptococcus pyogenes* that is homologous to a sugar ABC transporter (ATP-binding protein) (Accession Nos. NP_607296.1; NC_003485), about 59% identity from amino acids 5-503 with a protein from *Lactococcus lactis* subsp. *lactis* that is a sugar ABC transporter ATP binding protein (Accession Nos. NP_267484.1; NC_002662), about 61% identity from amino acids 7-503 with a protein from *Streptococcus pneumoniae* that is a sugar ABC transporter, ATP-binding protein (Accession Nos. NP_345337.1; NC_003028), and 60% identity from amino acids 7-503 with a protein from *Streptococcus pneumoniae* that is a ABC transporter ATP-binding protein—ribose/galactose transport (Accession Nos. NP_358342.1; NC_003098).

A Gapped BlastP sequence alignment showed that SEQ ID NO:72 (383 amino acids) has about 49% identity from amino acids 7-351 with a protein from *Lactococcus lactis* subsp. *lactis* that is a sugar ABC transporter permease protein (Accession Nos. NP_267485.1; NC_002662), about 47% identity from amino acids 4-351 with a protein from *Streptococcus pneumoniae* that is an ABC transporter membrane-spanning permease (ribose/galactose transport) (Accession Nos. NP_358343.1; NC_003098), about 47% identity from amino acids 4-351 with a protein from *Streptococcus pneumoniae* that is homologous to a sugar ABC transporter, permease protein (Accession Nos. NP_345338.1; NC_003028), about 49% identity from amino acids 4-342 with a protein from *Streptococcus pyogenes* that is homologous to a sugar ABC transporter (permease protein) (Accession Nos. NP_269364.1; NC_002737), and 49% identity from amino acids 4-342 with a protein from *Streptococcus pyogenes* that is homologous to a sugar ABC transporter (permease protein) (Accession Nos. NP_607295.1; NC_003485).

A Gapped BlastP sequence alignment showed that SEQ ID NO:74 (318 amino acids) has about 67% identity from amino acids 1-318 with a protein from *Streptococcus pyogenes* that is homologous to a sugar ABC transporter (permease protein) (Accession Nos. NP_607294.1; NC_003485), about 66% identity from amino acids 1-318 with a protein from *Streptococcus pyogenes* that is homologous to a sugar ABC transporter (permease protein) (Accession Nos. NP_269363.1; NC_002737), about 65% identity from amino acids 1-318 with a protein from *Streptococcus pneumoniae* that is homologous to a sugar ABC transporter, permease protein (Accession Nos. NP_345339.1; NC_003028), about 63% identity from amino acids 1-318 with a protein from *Lactococcus lactis* subsp. *lactis* that is a sugar ABC transporter permease protein (Accession Nos. NP_267486.1; NC_002662), and 61% identity from amino acids 6-318 with a protein from *Listeria innocua* that is homologous to a sugar ABC transporter (permease protein) (Accession Nos. NP_470764.1; NC_003212).

A Gapped BlastP sequence alignment showed that SEQ ID NO:76 (450 amino acids) has about 68% identity from amino acids 11-448 with a protein from *Neisseria meningitidis* that is homologous to a sugar transporter (Accession Nos. NP_273437.1; NC_003112), about 68% identity from amino acids 11-448 with a protein from *Neisseria meningitidis* that is homologous to an integral membrane transport protein (Accession Nos. NP_284797.1; NC_003116), about 39% identity from amino acids 17-229 with a protein from *Caulobacter crescentus* that is homologous to a transporter (Accession Nos. NP_421086.1; NC_002696), about 21% identity from amino acids 31-450 with a protein from *Lycopersicon esculentum* that is a sucrose transporter (Accession Nos. gb|AAG09270.1; AF176950), and 21% identity from amino acids 31-442 with a protein from *Arabidopsis thaliana* that is a sucrose transporter (Accession Nos. gb|AAG09191.1; AF175321).

A Gapped BlastP sequence alignment showed that SEQ ID NO:78 (495 amino acids) has about 32% identity from amino acids 8-482 with a protein from *Lactococcus lactis* subsp. *lactis* that is a transporter protein (Accession Nos. NP_266394.1; NC_002662), about 34% identity from amino acids 8-482 with a protein from *Listeria monocytogenes* that is homologous to an efflux transporter (Accession Nos. NP_464506.1; NC_003210), about 34% identity from amino acids 8-482 with a protein from *Listeria innocua* that is homologous to an efflux transporter (Accession Nos. NP_470317.1; NC_003212), about 30% identity from amino acids 7-422 with a protein from *Clostridium acetobutylicum* that is an MDR related permease (Accession Nos. NP_149294.1; NC_001988), and 29% identity from amino acids 8-425 with a protein from *Streptomyces coelicolor* that is homologous to a membrane transport protein (Accession Nos. emb|CAB89031.1; AL353870).

A Gapped BlastP sequence alignment showed that SEQ ID NO:80 (471 amino acids) has about 32% identity from amino acids 1-440 with a protein from *Lactococcus lactis* subsp. *lactis* that is a transporter protein (Accession Nos. NP_266394.1; NC_002662), about 34% identity from amino acids 1-464 with a protein from *Listeria monocytogenes* that is homologous to an efflux transporter (Accession Nos. NP_464506.1; NC_003210), about 34% identity from amino acids 1-464 with a protein from *Listeria innocua* that is homologous to an efflux transporter (Accession Nos. NP_470317.1; NC_003212), about 29% identity from amino acids 1-412 with a protein from *Clostridium acetobutylicum* that is an MDR related permease (Accession Nos. NP_149294.1; NC_001988), and 28% identity from amino acids 4-459 with a protein from *Streptomyces coelicolor* that is homologous to an exporter (Accession No. pir||T36377).

A Gapped BlastP sequence alignment showed that SEQ ID NO:82 (412 amino acids) has about 49% identity from amino acids 18-400 with a protein from *Listeria innocua* that is homologous to a drug-efflux transporter (Accession Nos. NP_472212.1; NC_003212), about 49% identity from amino acids 18-400 with a protein from *Listeria monocytogenes* that is homologous to a drug-efflux transporter (Accession Nos. NP_466263.1; NC_003210), about 48% identity from amino acids 18-397 with a protein from *Escherichia coli* that is homologous to a transport protein (Accession Nos. NP_415571.1; NC_000913), about 47% identity from amino acids 15-399 with a protein from *Lactococcus lactis* subsp. *lactis* that is a multidrug resistance efflux pump (Accession Nos. NP_266282.1; NC_002662), and 48% identity from amino acids 18-399 with a protein from *Salmonella typhimurium* that is homologous to an MFS family transport protein (Accession Nos. NP_460125.1; NC_003197).

A Gapped BlastP sequence alignment showed that SEQ ID NO:84 (462 amino acids) has about 38% identity from amino acids 9-413 with ORFC from *Oenococcus oeni* (Accession Nos. emb|CAB61253.1; AJ250422), about 38% identity from amino acids 2-378 with a protein from *Lactococcus lactis* subsp. *lactis* that is a transporter protein (Accession Nos. NP_267695.1; NC_002662), about 34% identity from amino acids 6-411 with a protein from *Streptococcus pyogenes* that is homologous to a drug resistance protein (Accession Nos. NP_606824.1; NC_003485), about 33% identity from amino acids 6-411 with a protein from *Streptococcus pyogenes* that is homologous to a drug resistance protein (Accession Nos. NP_268834.1; NC_002737), and 34% identity from amino acids 2-454 with a protein from *Lactococcus lactis* subsp. *lactis* that is a drug-export protein (Accession Nos. NP_267504.1; NC_002662).

A Gapped BlastP sequence alignment showed that SEQ ID NO:86 (490 amino acids) has about 55% identity from amino acids 3-476 with a protein from *Listeria monocytogenes* that is homologous to a drug-export protein (Accession Nos. NP_466111.1; NC_003210), about 54% identity from amino acids 3-476 with a protein from *Listeria innocua* that is homologous to a drug-export protein (Accession Nos. NP_472062.1; NC_003212), about 45% identity from amino acids 6-478 with a protein from *Lactococcus lactis* subsp. *lactis* that is a multidrug resistance protein (Accession Nos. NP_267065.1; NC_002662), about 49% identity from amino acids 8-484 with a protein from *Bacillus subtilis* that is homologous to a multidrug resistance protein (Accession Nos. NP_388266.1; NC_000964), and 44% identity from amino acids 18-425 with a protein from *Bacillus subtilis* that is homologous to a multidrug resistance protein (Accession Nos. NP_388782.1; NC_000964).

A Gapped BlastP sequence alignment showed that SEQ ID NO:88 (416 amino acids) has about 26% identity from amino acids 17-408 with a protein from *Desulfitobacterium hafniense* (Accession Nos. gb|AAL87781.1; AF403184), about 25% identity from amino acids 26-408 with a protein from *Streptococcus pneumoniae* that is transporter in the major facilitator superfamily (Accession Nos. NP_359046.1; NC_003098), about 21% identity from amino acids 61-399 with a protein from *Campylobacter jejuni* that is homologous to an efflux protein (Accession Nos. NP_282813.1; NC_002163), about 19% identity from amino acids 25-368 with a protein from *Agrobacterium tumefaciens* that is homologous to an MFS permease (Accession Nos. NP_533033.1; NC_003304), and 25% identity from amino acids 19-205 with a protein from *Bacillus halodurans* that is a multidrug resistance protein (Accession Nos. NP_244175.1; NC_002570).

A Gapped BlastP sequence alignment showed that SEQ ID NO:90 (548 amino acids) has about 38% identity from amino acids 17-546 with a protein from *Listeria innocua* that is homologous to a transporter protein (Accession Nos. NP_471001.1; NC_003212), about 37% identity from amino acids 17-546 with a protein from *Listeria monocytogenes* that is homologous to a transporter protein (Accession Nos. NP_465149.1; NC_003210), about 36% identity from amino acids 1-534 with a protein from *Streptococcus pneumoniae* that is a polysaccharide transporter (Accession Nos. NP_358976.1; NC_003098), about 36% identity from amino acids 17-534 with a protein from *Streptococcus pneumoniae* that is homologous to a polysaccharide biosynthesis protein (Accession Nos. NP_345978.1; NC_003028), and 35% identity from amino acids 12-546 with a hypothetical protein from *Lactococcus lactis* subsp. *lactis* (Accession Nos. NP_267962.1; NC_002662).

A Gapped BlastP sequence alignment showed that SEQ ID NO:92 (485 amino acids) has about 44% identity from amino acids 1-484 with a protein from *Listeria monocytogenes* that is homologous to an efflux transporter protein (Accession Nos. NP_464506.1; NC_003210), about 44% identity from amino acids 1-484 with a protein from *Listeria innocua* that is homologous to an efflux transporter protein (Accession Nos. NP_470317.1; NC_003212), about 34% identity from amino acids 9-420 with a protein from *Clostridium acetobutylicum* that is an MDR-related permease (Accession Nos. NP_149294.1; NC_001988), about 33% identity from amino acids 12-475 with a protein from *Lactococcus lactis* subsp. *lactis* that is a transporter protein (Accession Nos. NP_266394.1; NC_002662), and 34% identity from amino acids 1-457 with a hypothetical protein from *Myxococcus xanthus* (Accession Nos. emb|CAB37973.1; X76640).

A Gapped BlastP sequence alignment showed that SEQ ID NO:94 (199 amino acids) has about 46% identity from amino acids 23-173 with a protein from *Listeria innocua* that is homologous to a drug-efflux transporter protein (Accession Nos. NP_472212.1; NC_003212), about 45% identity from amino acids 23-173 with a protein from *Listeria monocytogenes* that is homologous to a drug-efflux transporter protein (Accession Nos. NP_466263.1; NC_003210), about 49% identity from amino acids 23-173 with a protein from *Lactococcus lactis* subsp. *lactis* that is a multidrug resistance efflux pump (Accession Nos. NP_266282.1; NC_002662), about 46% identity from amino acids 23-173 with a protein from *Salmonella enterica* subsp. *enterica* serovar *Typhi* that is homologous to an efflux pump (Accession Nos. NP_454977.1; NC_003198), and 46% identity from amino acids 23-173 with a protein from *Salmonella typhimurium* that is homologous to a permease (Accession Nos. NP_459377.1; NC_003197).

A Gapped BlastP sequence alignment showed that SEQ ID NO:96 (538 amino acids) has about 32% identity from amino acids 4-525 with a protein from *Streptococcus pneumoniae* that is a polysaccharide transporter (Accession Nos. NP_358976.1; NC_003098), about 32% identity from amino acids 5-525 with a protein from *Streptococcus pneumoniae* that is homologous to a polysaccharide biosynthesis protein (Accession Nos. NP_345978.1; NC_003028), about 33% identity from amino acids 5-526 with a conserved hypothetical protein from *Streptococcus pyogenes* (Accession Nos. NP_606680.1; NC_003485), about 33% identity from amino acids 5-526 with a conserved hypothetical protein from *Streptococcus pyogenes* (Accession Nos. NP_268708.1; NC_002737), and 30% identity from amino acids 4-526 with a hypothetical protein from *Lactococcus lactis* subsp. *lactis* (Accession Nos. NP_267962.1; NC_002662).

A Gapped BlastP sequence alignment showed that SEQ ID NO:98 (328 amino acids) has about 57% identity from amino acids 1-323 with a protein from *Pediococcus pentosaceus* that is a sucrose operon regulatory protein (scrR) (Accession No. sp|P43472|SCRR_PEDPE), about 51% identity from amino acids 1-322 with a protein from *Streptococcus pneumoniae* that is a sucrose operon repressor (Accession Nos. NP_346162.1; NC_003028), about 49% identity from amino acids 1-326 with a protein from *Streptococcus mutans* that is a sucrose operon regulatory protein (scrR) (Accession No. sp|Q54430|SCRR_STRMU), about 49% identity from amino acids 1-322 with a protein from *Streptococcus pyogenes* that is homologous to a sucrose operon repressor (Accession Nos. NP_607889.1; NC_003485), and 49% identity from amino acids 1-322 with a protein from *Streptococcus pyogenes* that is homologous to a sucrose operon repressor (Accession Nos. NP_269821.1; NC_002737).

A Gapped BlastP sequence alignment showed that SEQ ID NO:100 (485 amino acids) has about 50% identity from amino acids 1-466 with a protein from *Streptococcus sobrinus* that is a sucrose-6-phosphate hydrolase (ScrB) (Accession No. pir||S68598), about 49% identity from amino acids 1-461 with a protein from *Streptococcus pneumoniae* that is a sucrose-6-phosphate hydrolase (Accession Nos. NP_359160.1; NC_003098), about 49% identity from amino acids 1-461 with a protein from *Streptococcus pneumoniae* that is a sucrose-6-phosphate hydrolase (Accession Nos. NP_346161.1; NC_003028), about 49% identity from amino acids 1-466 with a protein from *Streptococcus pyogenes* that is homologous to a sucrose-6-phosphate hydrolase (Accession Nos. NP_607888.1; NC_003485), and 49% identity from amino acids 1-466 with a protein from *Streptococcus pyogenes* that is homologous to a sucrose-6-phosphate hydrolase (Accession Nos. NP_269820.1; NC_002737).

A Gapped BlastP sequence alignment showed that SEQ ID NO:102 (649 amino acids) has about 65% identity from amino acids 1-645 with a protein from *Streptococcus mutans* that is a phosphotransferase system enzyme II (EC 2.7.1.69), sucrose-specific IIABC component (Accession No. sp|P12655|PTSA_STRMU), about 56% identity from amino acids 1-647 with a protein from *Pediococcus pentosaceus* that is a phosphotransferase system enzyme II (EC 2.7.1.69), sucrose specific enzyme IIABC (Accession No. sp|P43470|PTSA_PEDPE), about 52% identity from amino acids 1-643 with a protein from *Lactococcus lactis* that is an enzyme II sucrose protein (Accession Nos. emb|CAB09690.1; Z97015), about 52% identity from amino acids 114-647 with a protein from *Lactobacillus sakei* that is a sucrose-specific enzyme II of the PTS (Accession Nos. gb|AAK92528.1; AF401046), and 45% identity from amino acids 1-621 with a protein from *Corynebacterium glutamicum* that is a phosphotransferase system IIB component (Accession Nos. NP_601842.1; NC_003450).

A Gapped BlastP sequence alignment showed that SEQ ID NO:104 (667 amino acids) has about 42% identity from amino acids 192-661 with a protein from *Lactococcus lactis* subsp. *lactis* that is a beta-glucoside-specific PTS system IIABC component (EC 2.7.1.69) (Accession Nos. NP_266583.1; NC_002662), about 39% identity from amino acids 191-652 with a protein from *Listeria monocytogenes* that is homologous to a phosphotransferase system (PTS) beta-glucoside-specific enzyme IIABC (Accession Nos. NP_464560.1; NC_003210), about 37% identity from amino acids 191-662 with a protein from *Clostridium longisporum* that is a PTS-dependent enzyme II (Accession Nos. gb|AAC05713.1; L49336), about 36% identity from amino acids 191-666 with a protein from *Bacillus halodurans* that is a PTS system, beta-glucoside-specific enzyme II, ABC component (Accession Nos. NP_241461.1; NC_002570), and 36% identity from amino acids 191-650 with a protein from *Listeria innocua* that is homologous to a PTS system, beta-glucosides specific enzyme IIABC (Accession Nos. NP_469373.1; NC_003212).

A Gapped BlastP sequence alignment showed that SEQ ID NO:106 (241 amino acids) has about 47% identity from amino acids 1-238 with a protein from *Bacillus subtilis* that is a trehalose operon transcriptional repressor (Accession No. sp|P39796|TRER_BACSU), about 41% identity from amino acids 4-238 with a protein from *Bacillus halodurans* that is a transcriptional repressor of the trehalose operon (Accession Nos. NP_241739.1; NC_002570), about 44% identity from amino acids 9-237 with a protein from *Listeria innocua* that is homologous to a transcription regulator GntR family (Accession Nos. NP_470558.1; NC_003212), about 44% identity from amino acids 9-237 with a protein from *Listeria monocytogenes* that is homologous to a transcription regulator GntR family (Accession Nos. NP_464778.1; NC_003210), and 41% identity from amino acids 5-238 with a protein from *Lactococcus lactis* subsp. *lactis* that is a GntR family transcriptional regulator (Accession Nos. NP_266581.1; NC_002662).

A Gapped BlastP sequence alignment showed that SEQ ID NO:108 (570 amino acids) has about 56% identity from amino acids 22-566 with a protein from *Streptococcus pyogenes* that is homologous to a dextran glucosidase (Accession Nos. NP_608103.1; NC_003485), about 57% identity from amino acids 23-568 with a protein from *Streptococcus pneumoniae* that is a dextran glucosidase (Accession Nos. NP_359290.1; NC_003098), about 56% identity from amino acids 22-566 with a protein from *Streptococcus pyogenes* that is homologous to a dextran glucosidase (Accession Nos. NP_270026.1; NC_002737), about 57% identity from amino acids 23-568 with a protein from *Streptococcus pneumoniae* that is homologous to a dextran glucosidase DexS (Accession Nos. NP_346315.1; NC_003028), and 54% identity from amino acids 17-570 with a protein from *Clostridium perfringens* that is an alpha-glucosidase (Accession Nos. NP_561478.1; NC_003366).

A Gapped BlastP sequence alignment showed that SEQ ID NO:110 (370 amino acids) has about 67% identity from amino acids 1-368 with a protein from *Streptococcus pneumoniae* that is an ABC transporter ATP-binding protein—multiple sugar transport (Accession Nos. NP_359030.1; NC_003098), about 67% identity from amino acids 1-368 with a protein from *Streptococcus pneumoniae* that is a sugar ABC transporter, ATP-binding protein (Accession Nos. NP_346026.1; NC_003028), about 66% identity from amino acids 1-368 with a protein from *Streptococcus mutans* that is a multiple sugar-binding transport ATP-binding protein (msmK) (Accession No. sp|Q00752|MSMK_STRMU), about 68% identity from amino acids 1-365 with a protein from *Listeria innocua* that is homologous to a sugar ABC transporter, ATP-binding protein (Accession Nos. NP_469649.1; NC_003212), and 67% identity from amino acids 1-365 with a protein from *Listeria monocytogenes* that is homologous to a sugar ABC transporter, ATP-binding protein (Accession Nos. NP_463809.1; NC_003210).

A Gapped BlastP sequence alignment showed that SEQ ID NO:112 (278 amino acids) has about 81% identity from amino acids 2-278 with a protein from *Streptococcus mutans* that is a multiple sugar-binding transport system permease protein (msmG) (Accession No. sp|Q00751|MSMG_STRMU), about 73% identity from amino acids 1-278 with a protein from *Streptococcus pneumoniae* that is a sugar ABC transporter, permease protein (Accession Nos. NP_346326.1; NC_003028), about 72% identity from amino acids 2-278 with a protein from *Streptococcus pneumoniae* that is a ABC transporter membrane spanning permease—multiple sugars (Accession Nos. NP_359302.1; NC_003098), about 85% identity from amino acids 72-278 with a hypothetical protein fragment from *Streptococcus mutans* (Accession No. pir||B27626), and 44% identity from amino acids 4-278 with a protein from *Clostridium acetobutylicum* that is a sugar permease (Accession Nos. NP_350251.1; NC_003030).

A Gapped BlastP sequence alignment showed that SEQ ID NO:114 (291 amino acids) has about 73% identity from amino acids 4-290 with a protein from *Streptococcus pneumoniae* that is an ABC transporter membrane-spanning permease—multiple sugars (Accession Nos. NP_359303.1; NC_003098), about 73% identity from amino acids 4-290 with a protein from *Streptococcus pneumoniae* that is a sugar ABC transporter, permease protein (Accession Nos. NP_346327.1; NC_003028), about 73% identity from amino acids 1-290 with a protein from *Streptococcus mutans* that is a multiple sugar-binding transport system permease protein (msmF) (Accession No. sp|Q00750|MSMF_STRMU), about 53% identity from amino acids 6-291 with a protein from *Clostridium acetobutylicum* that is an ABC-type sugar transport system, permease component (Accession Nos. NP_350252.1; NC_003030), and 32% identity from amino acids 2-291 with a protein from *Thermoanaerobacterium thermosulfurigenes* that is a potential starch degradation products transport system permease protein (Accession No. sp|P37730|AMYD_THETU).

A Gapped BlastP sequence alignment showed that SEQ ID NO:116 (423 amino acids) has about 60% identity from amino acids 8-421 with a protein from *Streptococcus mutans* that is a multiple sugar-binding protein precursor (Accession No. sp|Q00749|MSME_STRMU), about 56% identity from amino acids 9-421 with a protein from *Streptococcus pneumoniae* that is a sugar ABC transporter, sugar-binding protein (Accession Nos. NP_346328.1; NC_003028), about 56% identity from amino acids 9-421 with a protein from *Streptococcus pneumoniae* that is an ABC transporter substrate-binding protein—multiple sugars (Accession Nos. NP_359304.1; NC_003098), about 29% identity from amino acids 9-420 with a protein from *Clostridium acetobutylicum* that is an ABC-type sugar transport system, periplasmic sugar-binding component (Accession Nos. NP_350253.1; NC_003030), and 24% identity from amino acids 6-412 with a protein from *Bacillus subtilis* that is homologous to a multiple sugar-binding protein (Accession Nos. NP_391140.1; NC_000964).

A Gapped BlastP sequence alignment showed that SEQ ID NO:118 (279 amino acids) has about 57% identity from amino acids 1-273 with a protein from *Pediococcus pentosaceus* that is a raffinose operon transcriptional regulatory protein (rafR) (Accession No. sp|P43465|RAFR_PEDPE), about 35% identity from amino acids 5-273 with a protein from *Streptococcus mutans* that is homologous to a transcription regulator (msmR) (Accession No. pir||A42400), about 35% identity from amino acids 5-273 with a protein from *Streptococcus mutans* that is an msm operon regulatory protein (Accession No. sp|Q00753|MSMR_STRMU), about 36% identity from amino acids 19-273 with a protein from *Streptococcus pneumoniae* that is an msm operon regulatory protein (Accession Nos. NP_346330.1; NC_003028), and 36% identity from amino acids 19-273 with a protein from *Streptococcus pneumoniae* that is an msm (multiple sugar metabolism) operon regulatory protein (Accession Nos. NP_359306.1; NC_003098).

A Gapped BlastP sequence alignment showed that SEQ ID NO:120 (277 amino acids) has about 28% identity from amino acids 37-141 with a protein from *Treponema pallidum* that is homologous to an rRNA methylase (Accession Nos. NP_218549.1; NC_000919), about 32% identity from amino acids 74-141 with a protein from *Guillardia theta* that is a GTP-binding nuclear protein RAN (Accession Nos. NP_113408.1; NC_002753), about 29% identity from amino acids 75-141 with a protein from *Dictyostelium discoideum* that is a GTP-binding nuclear protein RAN/TC4 (Accession No. sp|P33519|RAN_DICDI), and about 25% identity from amino acids 140-190 with a putative protein from *Arabidopsis thaliana* (Accession Nos. NP_191798.1; NM_116104).

A Gapped BlastP sequence alignment showed that SEQ ID NO:122 (530 amino acids) has about 26% identity from amino acids 8-524 with a protein from *Lactococcus lactis* subsp. *lactis* that is an ABC transporter ATP binding and permease protein (Accession Nos. NP_267678.1; NC_002662), about 25% identity from amino acids 49-518 with a protein from *Streptococcus pneumoniae* that is an ABC transporter, ATP-binding protein (Accession Nos. NP_344680.1; NC_003028), about 25% identity from amino acids 49-518 with a protein from *Streptococcus pneumoniae* that is an ABC transporter ATP-binding/membrane spanning permease (Accession Nos. NP_357731.1; NC_003098), about 24% identity from amino acids 47-511 with a protein from *Synechocystis* sp. PCC 6803 that is an ABC transporter (Accession Nos. NP_440626.1; NC_000911), and 24% identity from amino acids 7-511 with a protein from *Bacillus subtilis* that is homologous to an ABC transporter (ATP-binding protein) (Accession Nos. NP_388852.1; NC_000964).

A Gapped BlastP sequence alignment showed that SEQ ID NO:124 (530 amino acids) has about 24% identity from amino acids 4-524 with a protein from *Lactococcus lactis* subsp. *lactis* that is an ABC transporter ATP binding and permease protein (Accession Nos. NP_267678.1; NC_002662), about 25% identity from amino acids 55-508 with a protein from *Streptococcus pneumoniae* that is an ABC transporter, ATP-binding protein (Accession Nos. NP_344680.1; NC_003028), about 25% identity from amino acids 55-508 with a protein from *Streptococcus pneumoniae* that is an ABC transporter ATP-binding/membrane spanning permease (Accession Nos. NP_357731.1; NC_003098), about 24% identity from amino acids 1-511 with a protein from *Streptococcus pneumoniae* that is a drug efflux ABC transporter, ATP-binding/permease (Accession Nos. NP_345800.1; NC_003028), and 24% identity from amino acids 1-511 with a protein from *Streptococcus pneumoniae* that is an ABC transporter ATP-binding/membrane spanning protein (Accession Nos. NP_358796.1; NC_003098).

A Gapped BlastP sequence alignment showed that SEQ ID NO:126 (527 amino acids) has about 25% identity from amino acids 8-527 with a protein from *Lactococcus lactis* subsp. *lactis* that is an ABC transporter ATP binding and permease protein (Accession Nos. NP_267678.1; NC_002662), about 24% identity from amino acids 13-520 with a protein from *Streptococcus pneumoniae* that is an ABC transporter ATP-binding/membrane spanning permease protein (Accession Nos. NP_357731.1; NC_003098), about 24% identity from amino acids 13-520 with a protein from *Streptococcus pneumoniae* that is an ABC transporter, ATP-binding protein (Accession Nos. NP_344680.1;

NC_003028), about 22% identity from amino acids 22-511 with a protein from *Streptococcus pneumoniae* that is a drug efflux ABC transporter, ATP-binding/permease protein (Accession Nos. NP_345800.1; NC_003028), and 22% identity from amino acids 22-511 with a protein from *Streptococcus pneumoniae* that is an ABC transporter ATP-binding/membrane spanning protein (Accession Nos. NP_358796.1; NC_003098).

A Gapped BlastP sequence alignment showed that SEQ ID NO:128 (534 amino acids) has about 23% identity from amino acids 14-512 with a protein from *Streptococcus pneumoniae* that is a comA protein (Accession No. pir||A39203), about 26% identity from amino acids 3-512 with a protein from *Lactococcus lactis* that is a Lactococcin A transport ATP-binding protein (lcnC) (Accession No. sp|Q00564|LCNC_LACLA), about 23% identity from amino acids 14-512 with a protein from *Streptococcus pneumoniae* that is a transport ATP-binding protein (ComA) (Accession Nos. NP_357637.1; NC_003098), about 25% identity from amino acids 113-509 with a protein from *Streptococcus salivarius* that is an ABC transporter (Accession Nos. gb|AAC72026.1; AF043280), and 22% identity from amino acids 14-512 with a protein from *Streptococcus pneumoniae* that is a competence factor transporting ATP-binding/permease protein (ComA) (Accession Nos. NP_344591.1; NC_003028).

A Gapped BlastP sequence alignment showed that SEQ ID NO:130 (527 amino acids) has about 23% identity from amino acids 16-524 with a protein from *Lactococcus lactis* subsp. *lactis* that is an ABC transporter ATP binding and permease protein (Accession Nos. NP 267678.1; NC_002662), about 25% identity from amino acids 6-520 with a protein from *Streptococcus pneumoniae* that is an ABC transporter, ATP-binding protein (Accession Nos. NP_344680.1; NC_003028), about 25% identity from amino acids 6-520 with a protein from *Streptococcus pneumoniae* that is an ABC transporter ATP-binding/membrane spanning permease (Accession Nos. NP_357731.1; NC_003098), about 24% identity from amino acids 105-511 with a protein from *Streptococcus pneumoniae* that is an ABC transporter ATP-binding/membrane spanning protein (Accession Nos. NP_358796.1; NC_003098), and 25% identity from amino acids 99-511 with a protein from *Nostoc* sp. PCC 7120 that is an ABC transporter ATP-binding protein (Accession Nos. NP_490403.1; NC_003276).

A Gapped BlastP sequence alignment showed that SEQ ID NO:132 (529 amino acids) has about 25% identity from amino acids 10-526 with a protein from *Lactococcus lactis* subsp. *lactis* that is an ABC transporter ATP binding and permease protein (Accession Nos. NP_267678.1; NC_002662), about 26% identity from amino acids 112-525 with a protein from *Streptococcus pneumoniae* that is an ABC transporter ATP-binding/membrane spanning permease (Accession Nos. NP_357731.1; NC_003098), about 26% identity from amino acids 112-525 with a protein from *Streptococcus pneumoniae* that is an ABC transporter, ATP-binding protein (Accession Nos. NP_344680.1; NC_003028), about 24% identity from amino acids 107-518 with a protein from *Brevibacillus brevis* that is homologous to an ABC-transporter (TycD) (Accession No. pir||T31077), and 24% identity from amino acids 83-521 with a protein from *Streptococcus pneumoniae* that is a drug efflux ABC transporter, ATP-binding/permease (Accession Nos. NP_345800.1; NC_003028).

A Gapped BlastP sequence alignment showed that SEQ ID NO:134 (600 amino acids) has about 23% identity from amino acids 2-600 with a protein from *Listeria innocua* that is homologous to an ABC transporter (permease) (Accession Nos. NP_471553.1; NC_003212), about 23% identity from amino acids 1-598 with a protein from *Listeria monocytogenes* that is homologous to an ABC transporter (permease) (Accession Nos. NP_465271.1; NC_003210), about 22% identity from amino acids 1-599 with a protein from *Clostridium perfringens* that is homologous to an ABC transporter (Accession Nos. NP_561767.1; NC_003366), about 22% identity from amino acids 1-564 with a protein from *Clostridium perfringens* that is homologous to an ABC-transporter (Accession Nos. NP_561039.1; NC_003366), and 22% identity from amino acids 4-593 with a protein from *Clostridium acetobutylicum* that is homologous to a permease (Accession Nos. NP_346868.1; NC_003030).

A Gapped BlastP sequence alignment showed that SEQ ID NO:136 (249 amino acids) has about 58% identity from amino acids 1-242 with a protein from *Clostridium perfringens* that is homologous to an ABC transporter (Accession Nos. NP_561766.1; NC_003366), about 55% identity from amino acids 3-242 with a protein from *Clostridium perfringens* that is homologous to an ABC transporter (Accession Nos. NP_561038.1; NC_003366), about 51% identity from amino acids 1-242 with a protein from *Listeria monocytogenes* that is homologous to an ABC transporter (ATP-binding protein) (Accession Nos. NP_465638.1; NC_003210), about 50% identity from amino acids 1-242 with a protein from *Listeria innocua* that is homologous to an ABC-transporter (ATP-binding protein) (Accession Nos. NP_471552.1; NC_003212), and 54% identity from amino acids 3-242 with a protein from *Clostridium acetobutylicum* that is an ABC transporter, ATP-binding protein (Accession Nos. NP_346867.1; NC_003030).

A Gapped BlastP sequence alignment showed that SEQ ID NO:138 (423 amino acids) has about 21% identity from amino acids 2-391 with a hypothetical protein from *Streptococcus pyogenes* (Accession Nos. NP_270004.1; NC_002737), about 21% identity from amino acids 2-383 with a hypothetical protein from *Streptococcus pyogenes* (Accession Nos. NP_608080.1; NC_003485), about 26% identity from amino acids 9-166 with a protein from *Bacillus subtilis* that is a yvbJ protein (Accession Nos. NP_391268.1; NC_000964), about 25% identity from amino acids 92-281 with a protein from caprine arthritis-encephalitis virus that is an env polyprotein precursor (Accession No. pir||VCLJC6), and 24% identity from amino acids 92-281 with a protein from Caprine arthritis-encephalitis virus that is an envelope glycoprotein (Accession Nos. gb|AAD14661.1; AF105181).

A Gapped BlastP (version) sequence alignment showed that SEQ ID NO:140 (438 amino acids) has about 27% identity from amino acids 86-216 with a protein from *Brochothrix campestris* that is a transport accessory protein (Accession Nos. gb|AAC95141.1; AF075600), about 26% identity from amino acids 107-219 with a protein from *Streptococcus pneumoniae* that is a bacterocin transport accessory protein (Accession Nos. NP_345950.1; NC_003028), about 26% identity from amino acids 107-219 with a protein from *Streptococcus pneumoniae* that is a Bta (Accession Nos. gb|AAD56628.1; AF165218), 23% identity from amino acids 88-201 with a hypothetical protein from *Bacillus anthracis* (Accession Nos. NP_052783.1; NC_001496), and 32% identity from amino acids 144-214 with a protein from *Neisseria meningitidis* that is a thioredoxin (Accession Nos. NP_274384.1; NC_003112).

A Gapped BlastP (version) sequence alignment showed that SEQ ID NO:142 (196 amino acids) has about 56% identity from amino acids 1-196 with a protein from *Lactobacillus gasseri* (Accession Nos. dbj|BAA82351.1; AB029612), about 49% identity from amino acids 10-196 with a hypothetical protein from *Lactobacillus* sp. (Accession No. sp|P29470|YLA1_LACAC), about 28% identity from amino acids 41-196 with a protein from *Lactobacillus casei* that is an ABC-transporter accessory factor (Accession Nos. NP_542220.1; NC_003320), 35% identity from amino acids 90-196 with a protein from *Lactobacillus plantarum* that is an accessory factor for ABC-transporter (PlnH) (Accession Nos. emb|CAA64190.1; X94434), and 30% identity from amino acids 41-196 with a protein from *Lactobacillus sake* that is homologous to an ABC exporter accessory factor (SapE) (Accession No. pir||A56973).

A Gapped BlastP (version) sequence alignment showed that SEQ ID NO:144 (720 amino acids) has about 62% identity from amino acids 9-720 with a protein from *Lactobacillus plantarum* that is an ABC-transporter (PlnG) (Accession Nos. emb|CAA64189.1; X94434), about 62% identity from amino acids 6-720 with a protein from *Lactobacillus sakei* that is homologous to a translocation protein (sppT), ATP-dependent (Accession No. pir||S57913), about 62% identity from amino acids 2-720 with a protein from *Lactobacillus sakei* that is an ATP-dependent transport protein (SapT) (Accession No. pir||I56273), 62% identity from amino acids 9-720 with a protein from *Lactobacillus casei* that is an ABC transporter (Accession Nos. NP_542219.1; NC_003320), and 57% identity from amino acids 25-718 with a protein from *Lactobacillus acidophilus* that is an ABC transporter (Accession Nos. NP_604412.1; NC_003458).

A Gapped BlastP (version) sequence alignment showed that SEQ ID NO:146 (234 amino acids) has about 52% identity from amino acids 13-228 with a protein from *Staphylococcus aureus* subsp. *aureus* that is homologous to an ABC transporter ATP-binding protein (Accession Nos. NP_370833.1; NC_002758), about 50% identity from amino acids 11-234 with a protein from *Streptococcus pyogenes* that is homologous to an ABC transporter (ATP-binding protein) (Accession Nos. NP_606994.1; NC_003485), about 50% identity from amino acids 11-234 with a protein from *Streptococcus pyogenes* that is homologous to an ABC transporter (ATP-binding protein) (Accession Nos. NP_268993.1; NC_002737), 50% identity from amino acids 13-232 with a protein from *Lactococcus lactis* subsp. *lactis* that is an ABC transporter ATP-binding protein (Accession Nos. NP_266815.1; NC_002662), and 53% identity from amino acids 11-233 with a protein from *Lactococcus lactis* subsp. *lactis* that is an ABC transporter ATP-binding protein (Accession Nos. NP_268413.1; NC_002662).

A Gapped BlastP (version) sequence alignment showed that SEQ ID NO:148 (353 amino acids) has about 40% identity from amino acids 1-352 with a hypothetical protein from *Lactococcus lactis* subsp. *lactis* (Accession Nos. NP_268412.1; NC_002662), about 38% identity from amino acids 1-352 with a conserved hypothetical protein from *Staphylococcus aureus* subsp. *aureus* (Accession Nos. NP_370832.1; NC_002758), about 33% identity from amino acids 1-352 with a conserved hypothetical protein from *Streptococcus pyogenes* (Accession Nos. NP_268992.1; NC_002737), 33% identity from amino acids 1-352 with a conserved hypothetical protein from *Streptococcus pyogenes* (Accession Nos. NP_606993.1; NC_003485), and 34% identity from amino acids 1-352 with a protein from *Lactococcus lactis* subsp. *lactis* that is an ABC transporter permease protein (Accession Nos. NP_266816.1; NC_002662).

A Gapped BlastP (version) sequence alignment showed that SEQ ID NO:150 (188 amino acids) has about 47% identity from amino acids 14-85 with a protein from *Lactococcus lactis* subsp. *lactis* that is a transcriptional regulator (Accession Nos. NP_266817.1; NC_002662), about 28% identity from amino acids 21-90 with a protein from *Aquifex aeolicus* that is a transcriptional regulator in the TetR/AcrR family (Accession Nos. NP_213195.1; NC_000918), about 30% identity from amino acids 14-75 with a protein from *Clostridium acetobutylicum* that is a transcriptional regulator in the AcrR family (Accession Nos. NP_348163.1; NC_003030), 29% identity from amino acids 25-109 with a protein from *Streptomyces coelicolor* that is homologous to a transcriptional regulator (Accession Nos. emb|CAB93030.1; AL357432), and 41% identity from amino acids 27-88 with a protein from *Clostridium acetobutylicum* that is a transcriptional regulator in the TetR/AcrR family (Accession Nos. NP_347457.1; NC_003030).

A Gapped BlastP (version) sequence alignment showed that SEQ ID NO:152 (236 amino acids) has about 65% identity from amino acids 3-236 with a protein from *Streptococcus pneumoniae* that is an ABC transporter ATP-binding protein (Accession Nos. NP_359090.1; NC_003098), about 66% identity from amino acids 4-236 with a protein from *Streptococcus pneumoniae* that is an ABC transporter, ATP-binding protein (Accession Nos. NP_346092.1; NC_003028), about 65% identity from amino acids 4-236 with a protein from *Streptococcus pyogenes* that is homologous to an ABC transporter (ATP-binding protein) (Accession Nos. NP_607321.1; NC_003485), 65% identity from amino acids 4-236 with a protein from *Streptococcus pyogenes* that is homologous to an ABC transporter (ATP-binding protein) (Accession Nos. NP_269390.1; NC_002737), and 62% identity from amino acids 4-236 with a protein from *Listeria monocytogenes* that is homologous to a ABC transporter, ATP-binding protein (Accession Nos. NP_464748.1; NC_003210).

A Gapped BlastP (version) sequence alignment showed that SEQ ID NO:154 (846 amino acids) has about 41% identity from amino acids 6-846 with a protein from *Lactococcus lactis* subsp. *lactis* that is an ABC transporter permease protein (Accession Nos. NP_267260.1; NC_002662), about 34% identity from amino acids 2-846 with a hypothetical protein from *Streptococcus pneumoniae* (Accession Nos. NP_359089.1; NC_003098), about 34% identity from amino acids 2-846 with a hypothetical protein from *Streptococcus pneumoniae* (Accession Nos. NP_346091.1; NC_003028), 33% identity from amino acids 4-846 with a hypothetical protein from *Streptococcus pyogenes* (Accession Nos. NP_269389.1; NC_002737), and 33% identity from amino acids 4-846 with a hypothetical protein from *Streptococcus pyogenes* (Accession Nos. NP_607320.1; NC_003485).

A Gapped BlastP (version) sequence alignment showed that SEQ ID NO:156 (78 amino acids) has about 30% identity from amino acids 12-70 with a protein from *Arabidopsis thaliana* (Accession Nos. gb|AAF19707.1; AC008047), about 30% identity from amino acids 12-70 with a protein from *Arabidopsis thaliana* that is homologous to an ATP dependent copper transporter (Accession Nos. NP_176533.1; NM_105023), about 32% identity from amino acids 1-65 with a hypothetical protein from *Pyrococcus furiosus* (Accession Nos. NP_579673.1; NC_003413), and 37% identity from amino acids 21-55 with a protein from Hepatitis TT virus (Accession Nos. gb|AAK11712.1; AF345529).

A Gapped BlastP (version) sequence alignment showed that SEQ ID NO:158 (379 amino acids) has about 36% identity from amino acids 32-368 with a conserved hypothetical protein from *Listeria innocua* (Accession Nos.

NP_470340.1; NC_003212), about 37% identity from amino acids 32-353 with a conserved hypothetical protein from *Listeria monocytogenes* (Accession Nos. NP_464529.1; NC_003210), about 36% identity from amino acids 87-370 with a protein from *Lactococcus lactis* (Accession Nos. emb|CAA68042.1; X99710), 31% identity from amino acids 28-372 with a hypothetical protein from *Lactococcus lactis* subsp. *lactis* (Accession Nos. NP_267885.1; NC_002662), and 30% identity from amino acids 32-348 with a protein from *Actinosynnema pretiosum* subsp. *auranticum* (Accession Nos. gb|AAC14002.1; U33059).

A Gapped BlastP (version) sequence alignment showed that SEQ ID NO:160 (779 amino acids) has about 61% identity from amino acids 1-308 with a protein from *Streptococcus mutans* that is an ABC transporter ATP binding subunit (Accession Nos. gb|AAD09218.1; U73183), about 37% identity from amino acids 1-362 with a protein from *Lactococcus lactis* subsp. *lactis* that is an ABC transporter ATP-binding and permease protein (Accession Nos. NP_266870.1; NC_002662), about 39% identity from amino acids 1-295 with a protein from *Listeria monocytogenes* that is homologous to an ABC transporter, ATP-binding protein (Accession Nos. NP_464271.1; NC_003210), 47% identity from amino acids 1-221 with a protein from *Archaeoglobus fulgidus* that is an ABC transporter, ATP-binding protein (Accession Nos. NP_070298.1; NC_000917), and 49% identity from amino acids 1-218 with a protein from *Archaeoglobus fulgidus* that is an ABC transporter, ATP-binding protein (Accession Nos. NP_069851.1; NC_000917).

A Gapped BlastP (version) sequence alignment showed that SEQ ID NO:162 (38 amino acids) has about 66% identity from amino acids 1-27 with a protein from *Clostridium acetobutylicum* that is a mannose-specific phosphotransferase system component (Accession Nos. NP_149230.1; NC_001988), about 72% identity from amino acids 3-27 with a protein from *Listeria monocytogenes* that is homologous to a PTS system mannose-specific factor IIAB (Accession Nos. NP_463629.1; NC_003210), about 72% identity from amino acids 3-27 with a protein from *Listeria innocua* that is homologous to a PTS system mannose-specific factor IIAB (Accession Nos. NP_469488.1; NC_003212), 66% identity from amino acids 1-27 with a protein from *Clostridium perfringens* that is a PTS system protein (Accession Nos. NP_561737.1; NC_003366), and 65% identity from amino acids 2-27 with a protein from *Streptococcus pyogenes* that is a mannose-specific phosphotransferase system component IIAB (Accession Nos. NP_269761.1; NC_002737).

A Gapped BlastP (version) sequence alignment showed that SEQ ID NO:164 (105 amino acids) has about 60% identity from amino acids 1-103 with a protein from *Listeria monocytogenes* that is homologous to a PTS system mannose-specific factor IIAB (Accession Nos. NP_463629.1; NC_003210), about 59% identity from amino acids 1-103 with a protein from *Listeria innocua* that is homologous to a PTS system mannose-specific factor IIAB (Accession Nos. NP_469488.1; NC_003212), about 57% identity from amino acids 1-104 with a protein from *Clostridium perfringens* that is a PTS system protein (Accession Nos. NP_561737.1; NC_003366), 53% identity from amino acids 1-104 with a protein from *Clostridium acetobutylicum* that is a mannose-specific phosphotransferase system component IIAB (Accession Nos. NP_149230.1; NC_001988), and 54% identity from amino acids 1-96 with a protein from *Streptococcus pyogenes* that is a mannose-specific phosphotransferase system component IIAB (Accession Nos. NP_607831.1; NC_003485).

A Gapped BlastP (version) sequence alignment showed that SEQ ID NO:166 (269 amino acids) has about 69% identity from amino acids 1-269 with a protein from *Listeria innocua* that is homologous to a PTS system mannose-specific, factor IIC (Accession Nos. NP_469489.1; NC_003212), about 69% identity from amino acids 1-269 with a protein from *Listeria monocytogenes* that is homologous to a PTS system mannose-specific, factor IIC (Accession Nos. NP_463630.1; NC_003210), about 67% identity from amino acids 1-269 with a protein from *Streptococcus pneumoniae* that is a PTS system, mannose-specific IIC component (Accession Nos. NP_344821.1; NC_003028), 65% identity from amino acids 1-269 with a protein from *Streptococcus pyogenes* that is homologous to a mannose-specific phosphotransferase system component IIC (Accession Nos. NP_269762.1; NC_002737), and 64% identity from amino acids 1-269 with a protein from *Clostridium acetobutylicum* that is a mannose/fructose-specific phosphotransferase system component IIC (Accession Nos. NP_149231.1; NC_001988).

A Gapped BlastP (version) sequence alignment showed that SEQ ID NO:168 (307 amino acids) has about 67% identity from amino acids 5-307 with a protein from *Listeria innocua* that is homologous to a PTS system mannose-specific factor IID (Accession Nos. NP_469490.1; NC_003212), about 67% identity from amino acids 5-307 with a protein from *Listeria monocytogenes* that is homologous to a PTS system mannose-specific factor IID (Accession Nos. NP_463631.1; NC_003210), about 64% identity from amino acids 6-303 with a protein from *Clostridium acetobutylicum* that is a mannose-specific phosphotransferase system component IID (Accession Nos. NP_149232.1; NC_001988), 64% identity from amino acids 4-300 with a protein from *Lactococcus lactis* subsp. *lactis* that is a mannose-specific PTS system component IID (EC 2.7.1.69) (Accession Nos. NP_267864.1; NC_002662), and 64% identity from amino acids 5-307 with a protein from *Streptococcus pneumoniae* that is a PTS system, mannose-specific IID component (Accession Nos. NP_344820.1; NC_003028).

A Gapped BlastP (version) sequence alignment showed that SEQ ID NO:170 (111 amino acids) has about 51% identity from amino acids 4-105 with a protein from *Streptococcus pyogenes* that is homologous to a PTS system enzyme II protein (Accession Nos. NP_269441.1; NC_002737), about 54% identity from amino acids 4-110 with a protein from *Listeria monocytogenes* that is homologous to a cellobiose phosphotransferase enzyme IIB component (Accession Nos. NP_466205.1; NC_003210), about 54% identity from amino acids 4-110 with a protein from *Listeria innocua* that is homologous to a cellobiose phosphotransferase enzyme IIB component (Accession Nos. NP_472159.1; NC_003212), 50% identity from amino acids 4-105 with a protein from *Streptococcus pyogenes* that is homologous to a PTS system enzyme II (Accession Nos. NP_607438.1; NC_003485), and 50% identity from amino acids 1-109 with a protein from *Lactococcus lactis* subsp. *lactis* that is a cellobiose-specific PTS system IIB component (EC 2.7.1.69) (Accession Nos. NP_266569.1; NC_002662).

A Gapped BlastP (version) sequence alignment showed that SEQ ID NO:172 (256 amino acids) has about 53% identity from amino acids 1-250 with a protein from *Streptococcus pneumoniae* that is a phosphotransferase system sugar-specific EII component (Accession Nos. NP_357876.1; NC_003098), about 53% identity from amino acids 1-250 with a protein from *Streptococcus pneumoniae* that is a PTS system IIC component (Accession Nos. NP_344847.1; NC_003028), about 43% identity from amino acids 1-255 with a protein from *Clostridium acetobutylicum* that is a PTS cellobiose-specific component IIC (Accession Nos. NP_347026.1; NC_003030), 38% identity from amino acids 1-249 with a protein from *Lactococcus lactis* subsp. *lactis* that is a cellobiose-specific PTS system IIC component (EC 2.7.1.69) (Accession Nos. NP_266572.1; NC_002662), and 37% identity from amino acids 1-255 with a protein from *Listeria innocua* that is homologous to a PTS system, cellobiose-specific IIC component (Accession Nos. NP_470241.1; NC_003212).

A Gapped BlastP (version) sequence alignment showed that SEQ ID NO:174 (560 amino acids) has about 39% identity from amino acids 1-551 with a protein from *Bacillus halodurans* that is a PTS system, beta-glucoside-specific enzyme II, ABC component (Accession Nos. NP_241162.1; NC_002570), about 39% identity from amino acids 1-551 with a protein from *Listeria monocytogenes* that is homologous to a phosphotransferase system (PTS) beta-glucoside-specific enzyme IIABC component (Accession Nos. NP_464265.1; NC_003210), about 38% identity from amino acids 1-554 with a protein from *Bacillus subtilis* that is a phosphotransferase system (PTS) beta-glucoside-specific enzyme IIABC component (Accession Nos. NP_806.1; NC_000964), 38% identity from amino acids 1-554 with a protein from *Bacillus subtilis* that is a PTS system, beta-glucoside-specific IIABC component (EIIABC-BGL) (beta-glucoside-permease IIABC component) (Accession No. sp|P40739|PTBA_BACSU), and 37% identity from amino acids 1-554 with a protein from *Bacillus halodurans* that is a PTS system, beta-glucoside-specific enzyme II, ABC component (Accession Nos. NP_241461.1; NC_002570).

The top blast result for even SEQ ID NOS:176-308 is shown in Table 2.

TABLE 2

Top Blast result for SEQ ID NOS: 176-308

| SEQ ID NO: | ORF | Percent Identity | Amino Acid Range | Organism | Description | Accession No. |
|---|---|---|---|---|---|---|
| 176 | 1463 | 83 | 3 to 639 | *Lactobacillus helveticus* | lactose permease | emb|CAD55501.1 |
| 178 | 639 | 90 | 1 to 88 | *Lactobacillus johnsonii* NCC 533 | phosphocarrier protein HPr | ref|NP_964671.1 |
| 180 | 640 | 83 | 1 to 576 | *Lactobacillus johnsonii* NCC 533 | phosphoenolpyruvate-protein phosphotransferase (enzyme I) | ref|NP_964672.1 |
| 182 | 431 | 77 | 1 to 333 | *Lactobacillus delbrueckii* subsp. *bulgaricus* | pepR1 | emb|CAB76946.1 |
| 184 | 676 | 71 | 1 to 314 | *Lactobacillus johnsonii* NCC 533 | HPr(Ser) kinase/phosphatase | ref|NP_964704.1 |
| 186 | 1778 | 79 | 1 to 303 | *Lactobacillus johnsonii* NCC 533 | fructose-1-phosphate kinase | ref|NP_965684.1 |
| 188 | 1779 | 54 | 1 to 251 | *Lactobacillus johnsonii* NCC 533 |  | ref|NP_965685.1 |
| 190 | 1433 | 77 | 1 to 331 | *Lactobacillus plantarum* WCFS1 | glycerone kinase | ref|NP_784000.1 |
| 192 | 1434 | 64 | 3 to 194 | *Lactobacillus plantarum* WCFS1 | dihydroxyacetone kinase, phosphatase domain dak2 | ref|NP_784001.1 |
| 194 | 1436 | 73 | 1 to 231 | *Lactobacillus plantarum* WCFS1 | glycerol uptake facilitator protein | ref|NP_784003.1 |
| 196 | 1437 | 100 | 1 to 480 | *Lactobacillus acidophilus* | sucrose phosphorylase | gb|AAO21868.1 |
| 198 | 1438 | 100 | 1 to 732 | *Lactobacillus acidophilus* | alpha-galactosidase | gb|AAO21867.1 |
| 200 | 1457 | 74 | 1 to 327 | *Lactobacillus johnsonii* NCC 533 | aldose 1-epimerase | ref|NP_964716.1 |
| 202 | 1458 | 84 | 1 to 486 | *Lactobacillus helveticus* | galactose-1-P-uridyl transferase | emb|CAA40526.1 |
| 204 | 1459 | 89 | 1 to 387 | *Lactobacillus helveticus* | galactokinase | emb|CAA40525.1 |
| 206 | 1460 | 31 | 79 to 305 | *Lactobacillus plantarum* WCFS1 | cell surface protein precursor | ref|NP_784891.1 |
| 208 | 1461 | 27 | 2 to 201 | *Lactobacillus johnsonii* NCC 533 |  | ref|NP_964254.1 |
| 210 | 1462 | 74 | 1 to 665 | *Lactobacillus johnsonii* NCC 553 | beta-galactosidase | ref|NP_964713.1 |
| 212 | 1467 | 99 | 1 to 628 | *Lactobacillus acidophilus* | beta-galactosidase | dbj|BAA20536.1 |
| 214 | 1468 | 100 | 1 to 316 | *Lactobacillus acidophilus* | BGAM_LACAC beta-galactosidase small subunit (LACTASE) | sp|O07685 |
| 216 | 1469 | 95 | 1 to 330 | *Lactobacillus helveticus* | UDP-galactose 4-epimerase | emb|CAD55502.1 |

TABLE 2-continued

Top Blast result for SEQ ID NOS: 176-308

| SEQ ID NO: | ORF | Percent Identity | Amino Acid Range | Organism | Description | Accession No. |
|---|---|---|---|---|---|---|
| 218 | 1719 | 80 | 1 to 294 | Lactobacillus johnsonii NCC 533 | UTP-glucose-1-phosphate uridylyltransferase | ref|NP_965397.1 |
| 220 | 874 | 87 | 6 to 481 | Lactobacillus gasseri | JE0395 phospho-beta-galactosidase I-Lactobacillus gasseri | pir||JE0395 |
| 222 | 910 | 66 | 3 to 308 | Lactobacillus gasseri | COG0039: Malate/lactate dehydrogenases | ref|ZP_00046547.1 |
| 224 | 1007 | 55 | 13 to 279 | Lactobacillus gasseri | COG2240: Pyridoxal/pyridoxine/pyridoxamine kinase | ref|ZP_00046499.1 |
| 226 | 1812 | 71 | 3 to 766 | Lactobacillus johnsonii NCC 533 | alpha-glucosidase | ref|NP_965686.1 |
| 228 | 1632 | 69 | 1 to 457 | Lactobacillus johnsonii NCC 533 | succinate-semialdehyde dehydrogenase | ref|NP_965584.1 |
| 230 | 1401 | 89 | 1 to 454 | Lactobacillus gasseri | COG0446: Uncharacterized NAD(FAD)-dependent dehydrogenases | ref|ZP_00046159.1 |
| 232 | 1974 | 72 | 1 to 601 | acetolactate synthase, pyruvate dehydrogenase (cytochrome), glyoxylate carboligase, phosphonopyruvate decarboxylase | COG0028: Thiamine pyrophosphate-requiring enzymes | ref|ZP_00047198.1 |
| 234 | 1102 | 56 | 1 to 269 | Lactobacillus helveticus | transmembrane protein | emb|CAA05490.1 |
| 236 | 1783 | 68 | 1 to 298 | Lactobacillus johnsonii NCC 533 | ABC transporter ATPase component | ref|NP_965688.1 |
| 238 | 1879 | 72 | 9 to 268 | Lactobacillus gasseri | COG0351: Hydroxymethylpyrimidine/phosphomethylpyrimidine kinase | ref|ZP_00046866.1 |
| 240 | 680 | 56 | 8 to 633 | Streptococcus agalactiae NEM316 | | ref|NP_735321.1 |
| 242 | 55 | 96 | 8 to 349 | Lactobacillus gasseri | COG1052: Lactate dehydrogenase and related dehydrogenases | ref|ZP_00046778.2 |
| 244 | 185 | 97 | 1 to 230 | Lactobacillus gasseri | COG0588: Phosphoglycerate mutase 1 | ref|ZP_00047243.1 |
| 246 | 271 | 91 | 1 to 323 | Lactobacillus helveticus | lactate dehydrogenase | emb|CAB03618.1 |
| 248 | 698 | 92 | 1 to 338 | Lactobacillus johnsonii NCC 533 | glyceraldehyde 3-phosphate dehydrogenase | ref|NP_964727.1 |
| 250 | 699 | 93 | 1 to 403 | Lactobacillus johnsonii NCC 533 | phosphoglycerate kinase | ref|NP_964728.1 |
| 252 | 752 | 83 | 3 to 445 | Lactobacillus gasseri | COG0166: Glucose-6-phosphate isomerase | ref|ZP_00046229.1 |
| 254 | 889 | 93 | 1 to 428 | Lactobacillus gasseri | COG0148: Enolase | ref|ZP_00046557.1 |
| 256 | 956 | 78 | 1 to 319 | Lactobacillus johnsonii NCC 533 | 6-phosphofructokinase | ref|NP_964935.1 |
| 258 | 957 | 88 | 1 to 589 | Lactobacillus gasseri | COG0469: Pyruvate kinase | ref|ZP_00046514.1 |
| 260 | 1599 | 81 | 1 to 303 | Lactobacillus johnsonii NCC 533 | fructose-bisphosphate aldolase | ref|NP_964539.1 |

TABLE 2-continued

Top Blast result for SEQ ID NOS: 176-308

| SEQ ID NO: | ORF | Percent Identity | Amino Acid Range | Organism | Description | Accession No. |
|---|---|---|---|---|---|---|
| 262 | 1641 | 71 | 1 to 433 | *Lactobacillus gasseri* | COG1653: ABC-type sugar transport system, periplasmic component | ref|ZP_00046816.2 |
| 264 | 452 | 69 | 1 to 335 | *Lactobacillus johnsonii* NCC 533 | phosphoenolpyruvate-dependent sugar phosphotransferase system | ref|NP_965752.1 |
| 266 | 1479 | 71 | 1 to 278 | *Lactobacillus johnsonii* NCC 533 | | ref|NP_965117.1 |
| 268 | 725 | 62 | 1 to 655 | *Lactobacillus gasseri* | COG1263: Phosphotransferase system IIC components, | ref|ZP_00046302.1 |
| 270 | 1369 | 81 | 1 to 411 | *Lactobacillus johnsonii* NCC 533 | phosphoenolpyruvate-dependent sugar phosphotransferase system EIIC, | ref|NP_964585.1 |
| 272 | 227 | 52 | 1 to 436 | *Enterococcus faecalis* V583 | PTS system, IIC component | ref|NP_814084.1 |
| 274 | 502 | 100 | 1 to 431 | *Lactobacillus acidophilus* | substrate-binding protein MsmE | gb|AAO21856.1 |
| 276 | 507 | 100 | 1 to 480 | *Lactobacillus acidophilus* | sucrose phosphorylase | gb|AAO21861.1 |
| 278 | 1483 | 59 | 1 to 492 | *Streptococcus agalactiae* NEM316 | | ref|NP_734585.1 |
| 280 | 1484 | 75 | 1 to 131 | *Lactobacillus johnsonii* NCC 533 | high affinity ribose transport protein rbsD | ref|NP_965069.1 |
| 282 | 552 | 76 | 1 to 487 | *Lactobacillus johnsonii* NCC 533 | major facilitator superfamily permease | ref|NP_964553.1 |
| 284 | 567 | 79 | 3 to 400 | *Lactobacillus gasseri* | COG0477: Permeases of the major facilitator superfamily | ref|ZP_00045998.1 |
| 286 | 1471 | 74 | 79 to 405 | *Lactobacillus johnsonii* NCC 533 | | ref|NP_965113.1 |
| 288 | 1853 | 80 | 4 to 163 | *Lactobacillus gasseri* | COG0477: Permeases of the major facilitator superfamily | ref|ZP_00046596.1 |
| 290 | 1012 | 77 | 9 to 643 | *Lactobacillus johnsonii* NCC 533 | phosphoenolpyruvate-dependent sugar phosphotransferase system | ref|NP_964612.1 |
| 292 | 1014 | 77 | 1 to 552 | *Lactobacillus gasseri* | COG0366: Glycosidases | ref|ZP_00045981.1 |
| 294 | 1440 | 100 | 1 to 277 | *Lactobacillus acidophilus* | transmembrane permease MsmG2 | gb|AAO21865.1 |
| 296 | 1442 | 100 | 1 to 418 | *Lactobacillus acidophilus* | substrate-binding protein MsmE2 | gb|AAO21863.1 |
| 298 | 1132 | 62 | 1 to 525 | *Lactobacillus gasseri* | COG1132: ABC-type multidrug transport system, ATPase and permease | ref|ZP_00045932.1 |
| 300 | 1358 | 37 | 1 to 525 | *Lactobacillus gasseri* | COG1132: ABC-type multidrug transport system, ATPase and permease | ref|ZP_00045932.1 |
| 302 | 1838 | 71 | 1 to 224 | *Lactobacillus johnsonii* NCC 533 | ABC transporter ATPase component | ref|ZP_965714.1 |
| 304 | 1840 | 50 | 1 to 172 | *Lactobacillus johnsonii* NCC 533 | | ref|ZP_965716.1 |
| 306 | 1913 | 72 | 1 to 233 | *Lactobacillus gasseri* | COG1136: ABC-type antimicrobial peptide transport system, ATPase | ref|ZP_00045892.1 |

TABLE 2-continued

Top Blast result for SEQ ID NOS: 176-308

| SEQ ID NO: | ORF | Percent Identity | Amino Acid Range | Organism | Description | Accession No. |
|---|---|---|---|---|---|---|
| 308 | 1938 | 59 | 19 to 364 | Lactobacillus johnsonii NCC 533 | | ref|NP_965786.1 |

EXAMPLE 2

PFAM Results for Amino Acid Sequences

Table 3 shows the top PFAM results for the amino acid sequences of the invention.

TABLE 3

PFAM Results for Amino Acid Sequences

| SEQ ID NO: | ORF | Domain | Amino Acid Range Start, Stop | Family | PFAM Accession No. | E-value |
|---|---|---|---|---|---|---|
| 3 | 877 | PTS_IIA | 16, 111 | PTS system, Lactose/Cellobiose specific IIA subunit | PF02255 | 8.20E−40 |
| 5 | 609 | PTS_EIIA_1 | 30, 134 | phosphoenolpyruvate-dependent sugar phosphotransferase system, EIIA 1 | PF00358 | 6.00E−55 |
| 7 | 1479 | PRD | 76, 171; 181, 282 | PRD domain | PF00874 | 9.90E−52 |
| 7 | 1479 | CAT_RBD | 6, 67 | CAT RNA binding domain | PF03123 | 1.10E−16 |
| 9 | 1574 | Glyco_hydro_1 | 4, 471 | Glycosyl hydrolase family 1 | PF00232 | 2.90E−133 |
| 11 | 1707 | PTS_EIIA_1 | 491, 595 | phosphoenolpyruvate-dependent sugar phosphotransferase system, EIIA 1 | PF00358 | 6.10E−53 |
| 11 | 1707 | PTS_EIIC | 105, 387 | Phosphotransferase system, EIIC | PF02378 | 3.10E−33 |
| 11 | 1707 | PTS_EIIB | 7, 41 | phosphotransferase system, EIIB | PF00367 | 8.50E−19 |
| 13 | 725 | PTS_EIIA_1 | 528, 632 | phosphoenolpyruvate-dependent sugar phosphotransferase system, EIIA 1 | PF00358 | 4.10E−60 |
| 13 | 725 | PTS_EIIC | 122, 419 | Phosphotransferase system, EIIC | PF02378 | 3.80E−35 |
| 13 | 725 | PTS_EIIB | 21, 55 | phosphotransferase system, EIIB | PF00367 | 8.90E−17 |
| 15 | 491 | PTS_EIIC | 35, 368 | Phosphotransferase system, EIIC | PF02378 | 6.90E−80 |
| 19 | 1684 | EIIA-man | 1, 115 | PTS system fructose IIA component | PF03610 | 1.20E−13 |
| 27 | 884 | PTS_EIIC | 34, 392 | Phosphotransferase system, EIIC | PF02378 | 7.70E−86 |
| 29 | 618 | PTS_EIIC | 29, 360 | Phosphotransferase system, EIIC | PF02378 | 8.70E−40 |
| 31 | 606 | PTS_EIIC | 9, 351 | Phosphotransferase system, EIIC | PF02378 | 3.10E−48 |
| 31 | 606 | PTS_EIIB | 457, 491; 551, 585 | phosphotransferase system, EIIB | PF00367 | 1.40E−22 |
| 33 | 1705 | PTS_EIIA_1 | 531, 636 | phosphoenolpyruvate-dependent sugar phosphotransferase system, EIIA 1 | PF00358 | 3.90E−48 |
| 33 | 1705 | PTS_EIIC | 131, 412 | Phosphotransferase system, EIIC | PF02378 | 2.80E−38 |
| 33 | 1705 | PTS_EIIB | 10, 44 | phosphotransferase system, EIIB | PF00367 | 2.00E−13 |
| 35 | 1777 | PTS_IIB_fruc | 183, 285 | PTS system, Fructose specific IIB subunit | PF02379 | 2.40E−45 |
| 35 | 1777 | PTS_EIIC | 313, 597 | Phosphotransferase system, EIIC | PF02378 | 5.20E−34 |
| 35 | 1777 | PTS_EIIA_2 | 5, 149 | Phosphoenolpyruvate-dependent sugar phosphotransferase system, EIIA 2 | PF00359 | 2.60E−26 |
| 37 | 500 | Peripla_BP_1 | 68, 331 | Periplasmic binding proteins and sugar binding domain of the LacI family | PF00532 | 2.60E−10 |
| 37 | 500 | LacI | 11, 36 | Bacterial regulatory proteins, lacI family | PF00356 | 6.40E−10 |
| 39 | 502 | SBP_bacterial_1 | 28, 403 | Bacterial extracellular solute-binding protein | PF01547 | 1.50E−51 |
| 41 | 503 | BPD_transp_1 | 66, 287 | Binding-protein-dependent transport system inner membrane component | PF00528 | 2.30E−19 |
| 43 | 504 | BPD_transp_1 | 80, 279 | Binding-protein-dependent transport system inner membrane component | PF00528 | 1.00E−19 |
| 45 | 505 | Glyco_hydro_32 | 24, 409 | Glycosyl hydrolases family 32 | PF00251 | 5.50E−72 |
| 47 | 506 | ABC_tran | 31, 212 | ABC transporter | PF00005 | 2.70E−58 |
| 53 | 1482 | BPD_transp_2 | 5, 274 | Branched-chain amino acid transport system/ permease component | PF02653 | 6.40E−73 |
| 55 | 1483 | ABC_tran | 32, 219; 280, 472 | ABC transporter | PF00005 | 8.70E−88 |
| 59 | 1485 | PfkB | 4, 297 | pfkB family carbohydrate kinase | PF00294 | 4.70E−73 |
| 61 | 1864 | BPD_transp_1 | 70, 280 | Binding-protein-dependent transport system inner membrane component | PF00528 | 5.80E−13 |
| 63 | 1865 | BPD_transp_1 | 213, 451 | Binding-protein-dependent transport system inner membrane component | PF00528 | 2.90E−13 |

TABLE 3-continued

PFAM Results for Amino Acid Sequences

| SEQ ID NO: | ORF | Domain | Amino Acid Range Start, Stop | Family | PFAM Accession No. | E-value |
|---|---|---|---|---|---|---|
| 65 | 1866 | SBP_bac_1 | 7, 322 | Bacterial extracellular solute-binding protein | PF01547 | 1.40E−22 |
| 67 | 1867 | ABC_tran | 31, 212 | ABC transporter | PF00005 | 8.00E−58 |
| 69 | 1944 | ABC_tran | 34, 220; 287, 481 | ABC transporter | PF00005 | 8.20E−64 |
| 71 | 1945 | BPD_transp_2 | 53, 338 | Branched-chain amino acid transport system/permease component | PF02653 | 1.40E−43 |
| 73 | 1946 | BPD_transp_2 | 10, 297 | Branched-chain amino acid transport system/permease component | PF02653 | 9.40E−44 |
| 79 | 566 | Sugar_tr | 25, 93 | Sugar (and other) transporter | PF00083 | 1.10E−10 |
| 89 | 1616 | Polysacc_synt | 16, 329 | Polysaccharide biosynthesis protein | PF01943 | 1.70E−08 |
| 97 | 399 | Peripla_BP_1 | 60, 325 | Periplasmic binding proteins and sugar binding domain of the LacI family | PF00532 | 1.60E−18 |
| 97 | 399 | LacI | 3, 28 | Bacterial regulatory proteins, lacI family | PF00356 | 8.50E−11 |
| 99 | 400 | Glyco_hydro_32 | 37, 449 | Glycosyl hydrolases family 32 | PF00251 | 5.40E−158 |
| 101 | 401 | PTS_EIIA_1 | 517, 621 | phosphoenolpyruvate-dependent sugar phosphotransferase system, EIIA 1 | PF00358 | 2.00E−70 |
| 101 | 401 | PTS_EIIC | 111, 403 | Phosphotransferase system, EIIC | PF02378 | 4.60E−68 |
| 101 | 401 | PTS_EIIB | 7, 40 | phosphotransferase system, EIIB | PF00367 | 5.50E−14 |
| 103 | 1012 | PTS_EIIA_1 | 49, 153 | phosphoenolpyruvate-dependent sugar phosphotransferase system, EIIA 1 | PF00358 | 4.00E−45 |
| 103 | 1012 | PTS_EIIC | 301, 587 | Phosphotransferase system, EIIC | PF02378 | 1.20E−43 |
| 103 | 1012 | PTS_EIIB | 197, 231 | phosphotransferase system, EIIB | PF00367 | 2.40E−16 |
| 105 | 1013 | GntR | 5, 68 | Bacterial regulatory proteins, gntR family | PF00392 | 2.50E−15 |
| 107 | 1014 | Alpha-amylase | 28, 429 | Alpha amylase, catalytic domain | PF00128 | 1.50E−110 |
| 109 | 1439 | ABC_tran | 31, 212 | ABC transporter | PF00005 | 2.20E−58 |
| 109 | 1439 | TOBE | 301, 359 | TOBE domain | PF03459 | 6.80E−09 |
| 111 | 1440 | BPD_transp_1 | 162, 235 | Binding-protein-dependent transport system inner membrane component | PF00528 | 2.90E−27 |
| 113 | 1441 | BPD_transp_1 | 66, 290 | Binding-protein-dependent transport system inner membrane component | PF00528 | 1.60E−29 |
| 115 | 1442 | SBP_bacterial_1 | 48, 411 | Bacterial extracellular solute-binding protein | PF01547 | 1.20E−61 |
| 117 | 1443 | AraC_binding | 16, 159 | AraC-like ligand binding domain | PF02311 | 6.80E−30 |
| 117 | 1443 | HTH_AraC | 229, 273 | Bacterial regulatory helix-turn-helix proteins, AraC family | PF00165 | 8.40E−20 |
| 121 | 74 | ABC_tran | 346, 527 | ABC transporter | PF00005 | 2.80E−36 |
| 123 | 75 | ABC_tran | 346, 527 | ABC transporter | PF00005 | 9.20E−35 |
| 125 | 1131 | ABC_tran | 346, 527 | ABC transporter | PF00005 | 4.50E−35 |
| 125 | 1131 | ABC_membrane | 14, 280 | ABC transporter transmembrane region | PF00664 | 1.00E−08 |
| 127 | 1132 | ABC_tran | 347, 528 | ABC transporter | PF00005 | 4.80E−36 |
| 129 | 1357 | ABC_tran | 346, 527 | ABC transporter | PF00005 | 3.50E−33 |
| 131 | 1358 | ABC_tran | 348, 529 | ABC transporter | PF00005 | 1.30E−35 |
| 133 | 1679 | FtsX | 85, 182 | Predicted permease | PF02687 | 1.40E−08 |
| 135 | 1680 | ABC_tran | 35, 221 | ABC transporter | PF00005 | 1.90E−60 |
| 143 | 1796 | ABC_membrane | 164, 440 | ABC transporter transmembrane region | PF00664 | 5.10E−68 |
| 143 | 1796 | Peptidase_C39 | 10, 145 | Peptidase C39 family | PF03412 | 3.30E−64 |
| 143 | 1796 | ABC_tran | 512, 696 | ABC transporter | PF00005 | 1.60E−46 |
| 145 | 1838 | ABC_tran | 43, 228 | ABC transporter | PF00005 | 2.10E−56 |
| 147 | 1839 | FtsX | 192, 347 | Predicted permease | PF02687 | 4.80E−16 |
| 151 | 1913 | ABC_tran | 36, 217 | ABC transporter | PF00005 | 1.50E−57 |
| 153 | 1914 | FtsX | 246, 441; 668, 838 | Predicted permease | PF02687 | 7.60E−48 |
| 159 | 1939 | ABC_tran | 31, 216 | ABC transporter | PF00005 | 7.60E−57 |
| 159 | 1939 | FtsX | 594, 772 | Predicted permease | PF02687 | 3.00E−35 |
| 165 | 455 | EII-Sor | 1, 238 | PTS system sorbose-specific iic component | PF03609 | 8.00E−124 |
| 167 | 456 | EIID-AGA | 7, 307 | PTS system mannose/fructose/sorbose family IID component | PF03613 | 4.80E−184 |
| 169 | 876 | PTS_IIB | 5, 107 | PTS system, Lactose/Cellobiose specific IIB subunit | PF02302 | 1.40E−31 |
| 173 | 1575 | PTS_EIIA_1 | 425, 529 | phosphoenolpyruvate-dependent sugar phosphotransferase system, EIIA 1 | PF00358 | 6.70E−63 |
| 173 | 1575 | PTS_EIIC | 42, 322 | Phosphotransferase system, EIIC | PF02378 | 1.40E−39 |
| 175 | 1463 | PTS_EIIA_1 | 516, 608 | phosphoenolpyruvate-dependent sugar phosphotransferase system, EIIA 1 | PF00358 | 2.10E−28 |
| 177 | 639 | PTS-HPr | 1, 84 | PTS HPr component phosphorylation site | PF00381 | 7.10E−52 |
| 179 | 640 | PEP-utilizers_C | 252, 544 | PEP-utilising enzyme, TIM barrel domain | PF02896 | 8.30E−182 |
| 179 | 640 | PEP-utilisers_N | 5, 129 | PEP-utilising enzyme, N-terminal | PF05524 | 3.50E−57 |
| 179 | 640 | PEP-utilizers | 146, 227 | PEP-utilising enzyme, mobile domain | PF00391 | 4.60E−37 |
| 181 | 431 | LacI | 6, 31 | Bacterial regulatory proteins, lacI family | PF00356 | 1.90E−11 |
| 183 | 676 | Hpr_kinase_C | 133, 313 | HPr Serine kinase C-terminus | PF07475 | 3.50E−86 |
| 183 | 676 | Hpr_kinase_N | 3, 132 | HPr Serine kinase N terminus | PF02603 | 7.90E−26 |
| 185 | 1778 | PfkB | 7, 292 | pfkB family carbohydrate kinase | PF00294 | 1.50E−37 |
| 187 | 1779 | DeoR | 6, 231 | Bacterial regulatory proteins, deoR family | PF00455 | 1.30E−64 |
| 189 | 1433 | Dak1 | 16, 331 | Dak1 domain | PF02733 | 2.30E−104 |

TABLE 3-continued

PFAM Results for Amino Acid Sequences

| SEQ ID NO: | ORF | Domain | Amino Acid Range Start, Stop | Family | PFAM Accession No. | E-value |
|---|---|---|---|---|---|---|
| 191 | 1434 | Dak2 | 32, 189 | DAK2 domain | PF02734 | 4.10E−71 |
| 193 | 1436 | MIP | 1, 231 | Major intrinsic protein | PF00230 | 2.00E−39 |
| 195 | 1437 | Alpha-amylase | 10, 423 | Alpha amylase, catalytic domain | PF00128 | 3.60E−07 |
| 197 | 1438 | Melibiase | 293, 690 | Melibiase | PF02065 | 9.00E−252 |
| 199 | 1457 | Aldose_epim | 18, 326 | Aldose 1-epimerase | PF01263 | 7.30E−63 |
| 201 | 1458 | GalP_UDP_tr_C | 222, 430 | Galactose-1-phosphate uridyl transferase, C-terminal domain | PF02744 | 9.30E−106 |
| 201 | 1458 | GalP_UDP_transf | 15, 220 | Galactose-1-phosphate uridyl transferase, N-terminal domain | PF01087 | 2.30E−95 |
| 203 | 1459 | GHMP_kinases | 112, 351 | GHMP kinases putative ATP-binding protein | PF00288 | 2.00E−50 |
| 209 | 1462 | Glyco_hydro_42 | 192, 605 | Beta-galactosidase | PF02449 | 1.90E−150 |
| 211 | 1467 | Glyco_hydro_2_C | 333, 628 | Glycosyl hydrolases family 2, TIM barrel domain | PF02836 | 2.60E−146 |
| 211 | 1467 | Glyco_hydro_2_N | 39, 227 | Glycosyl hydrolases family 2, sugar binding domain | PF02837 | 2.00E−86 |
| 211 | 1467 | Glyco_hydro_2 | 229, 331 | Glycosyl hydrolases family 2, immunoglobulin-like beta-sandwich domain | PF00703 | 2.90E−21 |
| 213 | 1468 | Bgal_small_N | 4, 197 | Beta galactosidase small chain, N terminal domain | PF02929 | 3.30E−94 |
| 213 | 1468 | Bgal_small_C | 206, 315 | Beta galactosidase small chain, C terminal domain | PF02930 | 8.40E−61 |
| 215 | 1469 | Epimerase | 3, 324 | NAD dependent epimerase/dehydratase family | PF01370 | 2.00E−142 |
| 215 | 1469 | 3Beta_HSD | 2, 324 | 3-beta hydroxysteroid dehydrogenase/isomerase family | PF01073 | 1.00E−07 |
| 217 | 1719 | NTP_transferase | 5, 272 | Nucleotidyl transferase | PF00483 | 8.30E−28 |
| 219 | 874 | Glyco_hydro_1 | 2, 479 | Glycosyl hydrolase family 1 | PF00232 | 1.20E−136 |
| 221 | 910 | Ldh_1_N | 3, 142 | lactate/malate dehydrogenase, NAD binding domain | PF00056 | 1.60E−59 |
| 221 | 910 | Ldh_1_C | 144, 308 | lactate/malate dehydrogenase, alpha/beta C-terminal domain | PF02866 | 1.90E−32 |
| 223 | 1007 | PfkB | 130, 187; 217, 247 | pfkB family carbohydrate kinase | PF00294 | 3.10E−07 |
| 225 | 1812 | Glyco_hydro_31 | 105, 757 | Glycosyl hydrolases family 31 | PF01055 | 2.10E−120 |
| 227 | 1632 | Aldedh | 3, 456 | Aldehyde dehydrogenase family | PF00171 | 1.40E−98 |
| 229 | 1401 | Pyr_redox | 5, 294 | Pyridine nucleotide-disulphide oxidoreductase | PF00070 | 2.10E−65 |
| 231 | 1974 | TPP_enzyme_N | 4, 174 | Thiamine pyrophosphate enzyme, N-terminal TPP binding domain | PF02776 | 4.00E−34 |
| 231 | 1974 | TPP_enzyme_M | 193, 340 | Thiamine pyrophosphate enzyme, central domain | PF00205 | 1.40E−32 |
| 233 | 1102 | Sugar_transport | 16, 280 | Sugar transport protein | PF06800 | 1.60E−114 |
| 235 | 1783 | ABC_tran | 27, 204 | ABC transporter | PF00005 | 2.20E−44 |
| 237 | 1879 | PfkB | 129, 178; 212, 240 | pfkB family carbohydrate kinase | PF00294 | 5.50E−07 |
| 239 | 680 | Isoamylase_N | 25, 102 | Isoamylase N-terminal domain | PF02922 | 8.80E−19 |
| 239 | 680 | Alpha-amylase | 146, 495 | Alpha amylase, catalytic domain | PF00128 | 3.30E−08 |
| 241 | 55 | 2-Hacid_dh_C | 119, 309 | D-isomer specific 2-hydroxyacid dehydrogenase, NAD binding domain | PF02826 | 1.70E−100 |
| 241 | 55 | 2-Hacid_dh | 16, 113 | D-isomer specific 2-hydroxyacid dehydrogenase, catalytic domain | PF00389 | 1.50E−23 |
| 243 | 185 | PGAM | 2, 226 | Phosphoglycerate mutase family | PF00300 | 4.60E−117 |
| 245 | 271 | Ldh_1_N | 8, 147 | lactate/malate dehydrogenase, NAD binding domain | PF00056 | 9.40E−76 |
| 245 | 271 | Ldh_1_C | 149, 317 | lactate/malate dehydrogenase, alpha/beta C-terminal domain | PF02866 | 2.00E−75 |
| 247 | 698 | Gp_dh_C | 157, 318 | Glyceraldehyde 3-phosphate dehydrogenase, C-terminal domain | PF02800 | 9.70E−88 |
| 247 | 698 | Gp_dh_N | 3, 156 | Glyceraldehyde 3-phosphate dehydrogenase, NAD binding domain | PF00044 | 1.10E−82 |
| 249 | 699 | PGK | 1, 403 | Phosphoglycerate kinase | PF00162 | 1.20E−218 |
| 251 | 752 | PGI | 7, 442 | Phosphoglucose isomerase | PF00342 | 3.80E−136 |
| 253 | 889 | Enolase_C | 139, 427 | Enolase, C-terminal TIM barrel domain | PF00113 | 2.30E−126 |
| 253 | 889 | Enolase_N | 5, 135 | Enolase, N-terminal domain | PF03952 | 1.40E−58 |
| 255 | 956 | PFK | 2, 277 | Phosphofructokinase | PF00365 | 1.70E−174 |
| 257 | 957 | PK | 1, 346 | Pyruvate kinase, barrel domain | PF00224 | 4.30E−228 |
| 257 | 957 | PK_C | 360, 475 | Pyruvate kinase, alpha/beta domain | PF02887 | 2.20E−64 |
| 257 | 957 | PEP-utilizers | 490, 579 | PEP-utilising enzyme, mobile domain | PF00391 | 2.50E−32 |
| 259 | 1599 | F_bP_aldolase | 4, 285 | Fructose-bisphosphate aldolase class-II | PF01116 | 7.40E−97 |
| 261 | 1641 | SBP_bac_1 | 7, 343 | Bacterial extracellular solute-binding protein | PF01547 | 1.70E−27 |
| 263 | 452 | PTSIIB_sorb | 169, 319 | PTS system sorbose subfamily IIB component | PF03830 | 6.20E−76 |

TABLE 3-continued

PFAM Results for Amino Acid Sequences

| SEQ ID NO: | ORF | Domain | Amino Acid Range Start, Stop | Family | PFAM Accession No. | E-value |
|---|---|---|---|---|---|---|
| 263 | 452 | EIIA-man | 2, 120 | PTS system fructose IIA component | PF03610 | 1.60E−47 |
| 265 | 1479 | PRD | 76, 164; 181, 275 | PRD domain | PF00874 | 3.00E−39 |
| 265 | 1479 | CAT_RBD | 2, 60 | CAT RNA binding domain | PF03123 | 3.10E−16 |
| 267 | 725 | PTS_EIIA_1 | 516, 620 | phosphoenolpyruvate-dependent sugar phosphotransferase system, EIIA 1 | PF00358 | 9.10E−60 |
| 267 | 725 | PTS_EIIC | 111, 406 | Phosphotransferase system, EIIC | PF02378 | 1.40E−33 |
| 267 | 725 | PTS_EIIB | 9, 43 | phosphotransferase system, EIIB | PF00367 | 2.00E−16 |
| 269 | 1369 | PTS_EIIC | 31, 336 | Phosphotransferase system, EIIC | PF02378 | 1.30E−60 |
| 271 | 227 | PTS_EIIC | 26, 364 | Phosphotransferase system, EIIC | PF02378 | 1.40E−82 |
| 273 | 502 | SBP_bac_1 | 6, 344 | Bacterial extracellular solute-binding protein | PF01547 | 5.30E−35 |
| 277 | 1483 | ABC_tran | 28, 215; 276, 468 | ABC transporter | PF00005 | 6.40E−88 |
| 279 | 1484 | RbsD_FucU | 1, 131 | RbsD/FucU transport protein family | PF05025 | 5.90E−59 |
| 281 | 552 | Sugar_tr | 8, 111 | Sugar (and other) transporter | PF00083 | 1.80E−09 |
| 289 | 1012 | PTS_EIIA_1 | 25, 129 | phosphoenolpyruvate-dependent sugar phosphotransferase system, EIIA 1 | PF00358 | 8.70E−45 |
| 289 | 1012 | PTS_EIIC | 278, 562 | Phosphotransferase system, EIIC | PF02378 | 5.10E−40 |
| 289 | 1012 | PTS_EIIB | 173, 207 | phosphotransferase system, EIIB | PF00367 | 5.40E−16 |
| 291 | 1014 | Alpha-amylase | 11, 413 | Alpha amylase, catalytic domain | PF00128 | 1.00E−112 |
| 293 | 1440 | BPD_transp_1 | 69, 273 | Binding-protein-dependent transport system inner membrane component | PF00528 | 2.40E−27 |
| 295 | 1442 | SBP_bac_1 | 8, 337 | Bacterial extracellular solute-binding protein | PF01547 | 2.90E−45 |
| 297 | 1132 | ABC_tran | 342, 523 | ABC transporter | PE00005 | 5.60E−35 |
| 299 | 1358 | ABC_tran | 344, 525 | ABC transporter | PF00005 | 2.60E−35 |
| 301 | 1838 | ABC_tran | 33, 218 | ABC transporter | PF00005 | 2.40E−56 |
| 305 | 1913 | ABC_tran | 33, 214 | ABC transporter | PF00005 | 3.10E−57 |
| 307 | 1938 | DUF218 | 177, 331 | DUF218 domain | PF02698 | 1.10E−45 |

EXAMPLE 3

Sugar Metabolism Genes

Lactobacillus acidophilus has the ability to utilize a variety of carbohydrates, including mono-, di- and poly-saccharides, as shown by its API50 sugar fermentation pattern. In particular, complex dietary carbohydrates that escape digestion in the upper GI-tract, such as raffinose and fructooligosaccharides (Gibson et al. (1995) J. Nutr. 125:1401-1412; Barrangou et al. (2003) Proc. Natl. Acad. Sci. U.S.A 100:8957-8962) can be utilized. The NCFM genome encodes a large variety of genes related to carbohydrate utilization, including 20 phosphoenolpyruvate sugar-transferase systems (PTS) and 5 ATP binding cassette (ABC) families of transporters. Putative PTS transporters were identified for trehalose (ORF 1012)(SEQ ID NOS:103 and 289), fructose (ORF 1777) (SEQ ID NO:35), sucrose (ORF 401) (SEQ ID NO:101), glucose and mannose (ORF 452 (SEQ ID NOS:1 and 263), ORF 453 (SEQ ID NO:161), ORF 454 (SEQ ID NO:163), ORF 455 (SEQ ID NO:165) and ORF 456 (SEQ ID NO:167)), melibiose (ORF 1705)(SEQ ID NO:33), gentiobiose and cellobiose (ORF 1369)(SEQ ID NOS:17 and 269), salicin (ORF 876 (SEQ ID NO:169), ORF 877 (SEQ ID NO:3), ORF 879 (SEQ ID NO:171)), arbutin (ORF 884) (SEQ ID NO:27), and N-acetyl glucosamine (ORF 146) (SEQ ID NO:21). Putative ABC transporters were identified for FOS (ORF 502 (SEQ ID NOS:39 and 273) ORF 504 (SEQ ID NO:43), ORF 506 (SEQ ID NO:47)), raffinose (ORF 1439 (SEQ ID NO:109), ORF 1440 (SEQ ID NOS:111 and 293), ORF 1441 (SEQ ID NO:113), ORF 1442 (SEQ ID NOS:115 and 295), and maltose (ORF 1854-ORF 1857). A putative lactose-galactose permease was also identified (ORF 1463) (SEQ ID NO:175). Most of these transporters share a genetic locus with a glycosidase and a transcriptional regulator, allowing localized transcriptional control.

In silico analyses of the genome revealed the presence of genes representing the complete glycolysis pathway. Additionally, members of the general carbohydrate utilization regulation network were identified, namely HPr (ORF 639 (SEQ ID NO:177), ptsH), EI (ORF 640 (SEQ ID NO:179), ptsI), CcpA (ORF 431 (SEQ ID NO:181), ccpA), and HPrK/P (ORF 676 (SEQ ID NO:183), ptsK), indicating an active carbon catabolite repression network based on sugar availability.

EXAMPLE 4

Differentially Expressed Genes

Global gene expression patterns obtained from growth on eight different carbohydrates were visualized by cluster analysis (Eisen et al. (1998) Proc. Natl. Acad. Sci. USA 95:14863-14868) using Ward's hierarchical clustering method, volcano plots and contour plots. Overall, between 23 and 379 genes were differentially expressed between paired treatment conditions (with p-values below the Bonferroni correction), representing between 1% and 20% of the genome, respectively. All possible treatment comparisons were considered, and a gene was considered induced above a particular level if it showed induction in at least one treatment comparison. For genes that showed induction in more than one instance, the highest induction level was selected. Although 342 genes (18% of the genome) showed induction levels above two fold, only 63 genes (3% of the genome) showed induction above 4 fold, indicating a relatively small number of genes were highly induced. Although overall expression levels of the majority of the genes remained consistent regardless of the growth substrate (80% of the genome), select clusters showed differential transcription of genes and operons. Nevertheless, for each sugar, a limited number of genes showed specific induction.

In the presence of glucose, ORF 1679 (SEQ ID NO:133) and ORF 1680 (SEQ ID NO:135) were highly induced when compared to other monosaccharides (fructose, galactose) and di-saccharides (sucrose, lactose, trehalose). The induction levels compared to other sugars varied between 3.5 and 6.3 for ORF 1679 (SEQ ID NO:133) and between 3.7 and 4.7 for ORF 1680 (SEQ ID NO:135). ORF 1679 (SEQ ID NO:133) encodes an ABC nucleotide binding protein, including commonly found nucleotide binding domain motifs, namely WalkerA, WalkerB, ABC signature sequence and Linton and Higgins motif. ORF 1680 (SEQ ID NO:135) encodes an ABC permease, with 10 predicted membrane spanning domains. No solute binding protein is encoded in their vicinity, suggesting a possible role as an exporter rather than an importer. Several genes and operons were specifically repressed by glucose, including ORFs 680 (SEQ ID NO:239)-ORF 686, which are involved in glycogen metabolism. Since glycogen is metabolized by the cell in order to store energy, in the presence of the preferred carbon source such as glucose, energy storage is not necessary. Other genes repressed in the presence of glucose included proteins involved in uptake of alternative carbohydrate sources, and enzymes involved in hydrolysis of such carbohydrates.

The three genes of the putative fructose locus, ORF 1777 (SEQ ID NO:35) (FruA, fructose PTS transporter EIIABC$^{Fru}$), ORF 1778 (SEQ ID NO:185) (FruK, phosphofructokinase EC 2.7.1.56) and ORF 1779 (SEQ ID NO:187) (FruR, transcription regulator) were differentially expressed. Induction levels were up to 3.9, 4.3 and 4.6 for fruA, fruK and fruR, respectively. These results suggest fructose is transported into the cell via a PTS transporter, into fructose-6-phosphate, which the phosphofructokinase FruK phosphorylates into fructose-1,6 bi-phosphate, a glycolysis intermediate.

In the presence of sucrose, the three genes of the sucrose locus were differentially expressed, namely ORF 399 (SEQ ID NO:97)(ScrR, transcription regulator), ORF 400 (SEQ ID NO:99)(ScrB, sucrose-6-phosphate hydrolase EC 3.2.1.26), and ORF 401 (SEQ ID NO:101) (ScrA, sucrose PTS transporter EIIBCA$^{Suc}$). When compared to glucose, induction levels were up to 3.1, 2.8 and 17.2 for scrR, scrB and scrA, respectively. ORF 401 (SEQ ID NO:101) in particular showed high induction levels, between 8.0 and 17.2 when compared to mono- and di-saccharides. These results indicate that sucrose is transported into the cell via a PTS transporter, into sucrose-6-phosphate, which is subsequently hydrolyzed into glucose-6-phosphate and fructose by ScrB.

The six genes of the FOS operon were differentially expressed, namely ORF 502 (SEQ ID NOS:39 and 273), ORF 503 (SEQ ID NO:41), ORF 504 (SEQ ID NO:43), ORF 506 (SEQ ID NO:47) (MsmEFGK ABC transporter), ORF 505 (SEQ ID NO:45) (BfrA, β-fructosidase EC 3.2.1.26) and ORF 507 (SEQ ID NOS:49 and 275) (GtfA, sucrose phosphorylase EC 2.7.1.4). Induction levels varied between 15.1 and 40.6 when compared to mono- and di-saccharides, and between 5.5 and 8.9 when compared to raffinose. These results suggest FOS is transported into the cell via an ABC transporter and subsequently hydrolyzed into fructose and sucrose by the fructosidase. Sucrose is likely subsequently hydrolyzed into fructose and glucose-1-P by the sucrose phosphorylase. In addition to the FOS operon, FOS also induced the fructose operon, the sucrose PTS transporter, the trehalose operon and an ABC transporter (ORF 1679-ORF 1680) (SEQ ID NOS:133 and 135, respectively).

In the presence of raffinose, the six genes of the raffinose operon were specifically induced. The raffinose locus consists of ORF 1442 (SEQ ID NOS:115 and 295), ORF 1441 (SEQ ID NO:113), ORF 1440 (SEQ ID NOS:111 and 293), ORF 1439 (SEQ ID NO:109) (MsmEFGK$_2$ ABC transporter), ORF 1438 (SEQ ID NO:197) (MelA α-galactosidase EC 3.2.1.22), and ORF 1437 (SEQ ID NO:195) (GtfA$_2$, sucrose phosphorylase EC 2.7.1.4). Induction levels varied between 15.1 and 45.6, when compared to all other conditions. Additionally, ORFs 1433 (SEQ ID NO:189), 1434 (SEQ ID NO:191) (di-hydroxyacetone kinase EC 2.7.1.29), and ORF 1436 (SEQ ID NO:193) (glycerol uptake facilitator) were induced between 1.9 and 24.7 fold when compared to other conditions.

In the presence of lactose and galactose, ten genes distributed in two loci were differentially expressed, namely ORF 1463 (SEQ ID NO:175) (LacS permease of the GPH translocator family), ORF 1462 (SEQ ID NO:209) (LacZ, β-galactosidase EC 3.2.1.23), ORF 1461 (SEQ ID NO:207), ORF 1460 (SEQ ID NO:205)(surface protein), ORF 1459 (SEQ ID NO:203)(GalK, galactokinase EC 2.7.1.6), ORF 1458 (SEQ ID NO:201)(GalT, galactose-1 phosphate uridylyl transferase EC 2.7.7.10), ORF 1457 (SEQ ID NO:199)(GalM, galactose epimerase EC 5.1.3.3), ORFs 1467 (SEQ ID NO:211), 1468 (SEQ ID NO:213)(LacLM, β-galactosidase EC 3.2.1.23 large and small subunits), and 1469 (SEQ ID NO:215)(GalE, UDP-glucose epimerase EC 5.1.3.2). LacS (SEQ ID NO:175) is similar to GPH permeases previously identified in lactic acid bacteria. Although LacS (SEQ ID NO:175) contains an EIIA at the carboxy-terminus, it is not a PTS transporter. Also, LacS (SEQ ID NO:175) includes a His at position 553, which might be involved in interaction with HPr, as shown in S. salivarius (Lessard et al. (2003) J. Bacteriol. 185:6764-6772). In the presence of lactose and galactose, galKTM (SEQ ID NOS:199, 201, and 203) were induced between 3.7 and 17.6 fold; lacSZ (SEQ ID NOS:175 and 209) were induced between 2.8 and 17.6 fold; lacL (SEQ ID NO:213) and galE (SEQ ID NO:215) were induced between 2.7 and 29.5, when compared to other carbohydrates not containing galactose, i.e., glucose, fructose, sucrose, trehalose and FOS. These results suggest lactose is transported into the cell via the LacS permease of the galactoside-pentose hexuronide translocator family. Inside the cell, lactose is hydrolyzed into glucose and galactose by LacZ. Galactose is then phosphorylated by GalK into galactose-1 phosphate, further transformed into UDP-galactose by GalT. UDP-galactose is subsequently epimerized to UDP-glucose by GalE. UDP-glucose is likely turned into glucose-1P by ORF 1719 (SEQ ID NO:217), which encodes a UDP-glucose phosphorylase EC 2.7.7.9, consistently highly expressed. Finally, the phosphoglucomutase EC 5.4.2.2 likely acts on glucose-IP to yield glucose-6P, a glycolysis substrate.

The three genes of the putative trehalose locus were also differentially expressed. The trehalose locus consists of ORF 1012 (SEQ ID NOS:103 and 289)(encoding the TreB trehalose PTS transporter EIIABC$^{Tre}$ EC 2.7.1.69), ORF 1013 (SEQ ID NO:105)(TreR, trehalose regulator) and ORF 1014 (SEQ ID NOS:107 and 291) (TreC, trehalose-6 phosphate hydrolase EC 3.2.1.93). Induction levels were between 4.3 and 18.6 for treB (SEQ ID NOS:103 and 289), between 2.3 and 7.3 for treR (SEQ ID NO:105), and between 2.7 and 18.5 for treC (SEQ ID NOS:107 and 291), when compared to glucose, sucrose, raffinose and galactose. These results suggest trehalose is transported into the cell via a PTS transporter, phosphorylated to trehalose-6 phosphate and hydrolyzed into glucose and glucose-6 phosphate by TreC.

In addition, genes showing differential expression included sugar- and energy-related genes ORF 874 (SEQ ID NO:219) (beta galactosidase EC 3.2.1.86), ORF 910 (SEQ ID NO:221) (L-LDH EC 1.1.1.27), ORF 1007 (SEQ ID NO:223 (pyridoxal kinase 2.7.1.35), ORF 1812 (SEQ ID NO:225) (alpha glucosidase EC 3.2.1.3), ORF 1632 (SEQ ID NO:227) (aldehyde dehydrogenase EC 1.2.1.16), ORF 1401 (SEQ ID NO:229) (NADH peroxidase EC 1.11.1.1), ORF 1974 (SEQ ID NO:231) (pyruvate oxidase EC 1.2.3.3), adherence genes ORF 555, ORF 649, ORF 1019; aminopeptidase ORF 911, ORF 1086; amino-acid permease, ORF 1102 (SEQ ID NO:233) (membrane protein), ORF 1783 (SEQ ID NO:235) (ABC transporter), and ORF 1879 (SEQ ID NO:237)(pyrimidine kinase EC 2.7.4.7).

EXAMPLE 5

Real Time RT-PCR

Five genes that were differentially expressed in microarray experiments were selected for real-time quantitative RT-PCR experiments, in order to validate induction levels measured by microarrays. These genes were selected for both their broad expression range (LSM between −1.52 and +3.87), and induction levels between sugars (fold induction up to 34). All selected genes showed an induction level above 6 fold in at least one instance. Also, the annotations of the selected genes were correlated functionally with carbohydrate utilization. The five selected genes were: beta-fructosidase (ORF 505) (SEQ ID NO:45), trehalose PTS (ORF 1012) (SEQ ID NOS: 103 and 289), glycerol uptake facilitator (ORF 1436) (SEQ ID NO:193), beta-galactosidase (ORF 1467) (SEQ ID NO:211), and ABC transporter (ORF 1679) (SEQ ID NO:133).

For the five selected genes, induction levels were compared between six different treatments, resulting in 15 induction levels for each gene. The induction levels measured by microarrays were plotted against induction levels measured by Q-PCR, in order to validate microarray data. Individual R-square values ranged between 0.642 and 0.883 for each of the tested genes (between 0.652 and 0.978 using data in a $log_2$ scale). When the data were combined, the global R-square value was 0.78 (0.88 using data in a $log_2$ scale). A correlation analysis was run in SAS (Cary, N.C.), and showed a correlation between the two methods with P-values less than 0.001, for Spearman, Hoeffding and Kendall tests. Additionally, a regression analysis was run in excel (Microsoft, CA), and showed a statistically highly significant ($p<1.02\times10^{-25}$) correlation between microarray data and Q-PCR results. Nevertheless, Q-PCR measurements revealed larger induction levels, which is likely due to the smaller dynamic range of the microarray scanner, compared to that of the Q-PCR cycler. Similar results have been reported previously (Wagner et al. (2003) *J. Bacteriol.* 185:2080-2095).

EXAMPLE 6

Comparative Analysis

Comparative analyses of global transcription profiles determined for growth on eight carbohydrates identified the basis for carbohydrate transport and catabolism in *L. acidophilus*. Specifically, three different types of carbohydrate transporters were differentially expressed, namely phosphoenolpyruvate: sugar phosphotransferase system (PTS), ATP binding cassette (ABC) and galactoside-pentose hexuronide (GPH) translocator, illustrating the diversity of carbohydrate transporters used by *Lactobacillus acidophilus*. Transcription profiles suggested that galactosides were transported by a GPH translocator, while mono- and di-saccharides were transported by members of the PTS, and polysaccharides were transported by members of the ABC family.

Microarray results indicated fructose, sucrose and trehalose are transported by PTS transporters $EIIABC^{Fru}$ (ORF 1777) (SEQ ID NO:35), $EIIBCA^{Suc}$ (ORF 401) (SEQ ID NO:101) and $EIIABC^{Tre}$ (ORF 1012) (SEQ ID NOS:103 and 289), respectively. Those genes are encoded on typical PTS loci (FIG. 2), along with regulators and enzymes that have been well characterized in other organisms. In contrast, FOS and raffinose are transported by ABC transporters of the MsmEFGK family, ORFs 502 (SEQ ID NOS:39 and 273), 503 (SEQ ID NO:41), 504 (SEQ ID NO:43), and 505 (SEQ ID NO:45); and ORFs 1437(SEQ ID NO:195, ORF 1438 (SEQ ID NO:197), 1439 (SEQ ID NO:109), ORF 1440 (SEQ ID NOS:111 and 293), ORF 1441 (SEQ ID NO:113), and ORF 1442 (SEQ ID NOS:115 and 295), respectively. In the case of trehalose and FOS, microarray results correlate well with functional studies in which targeted knock out of carbohydrate transporters and hydrolases modified the saccharolytic potential of *Lactobacillus acidophilus* NCFM. Differential expression of the $EIIABC^{Tre}$ is consistent with recent work in *Lactobacillus acidophilus* indicating ORF 1012 (SEQ ID NOS:103 and 289) is involved in trehalose uptake. Similarly, differential expression of the fos operon is consistent with previous work in *Lactobacillus acidophilus* indicating those genes are involved in uptake and catabolism of FOS, and induced in the presence of FOS and repressed in the presence of glucose (Barrangou et al. (2003) *Proc. Natl. Acad. Sci. USA* 100: 8957-8962). Additionally, induction of the raffinose msm locus is consistent with previous work in *Streptococcus mutans* (Russell et al. (1992) *J. Biol. Chem.* 267: 4631-4637) and *Streptococcus pneumoniae* (Rosenow et al. (1999) *Genome Res.* 9:1189-1197).

Figure 2:
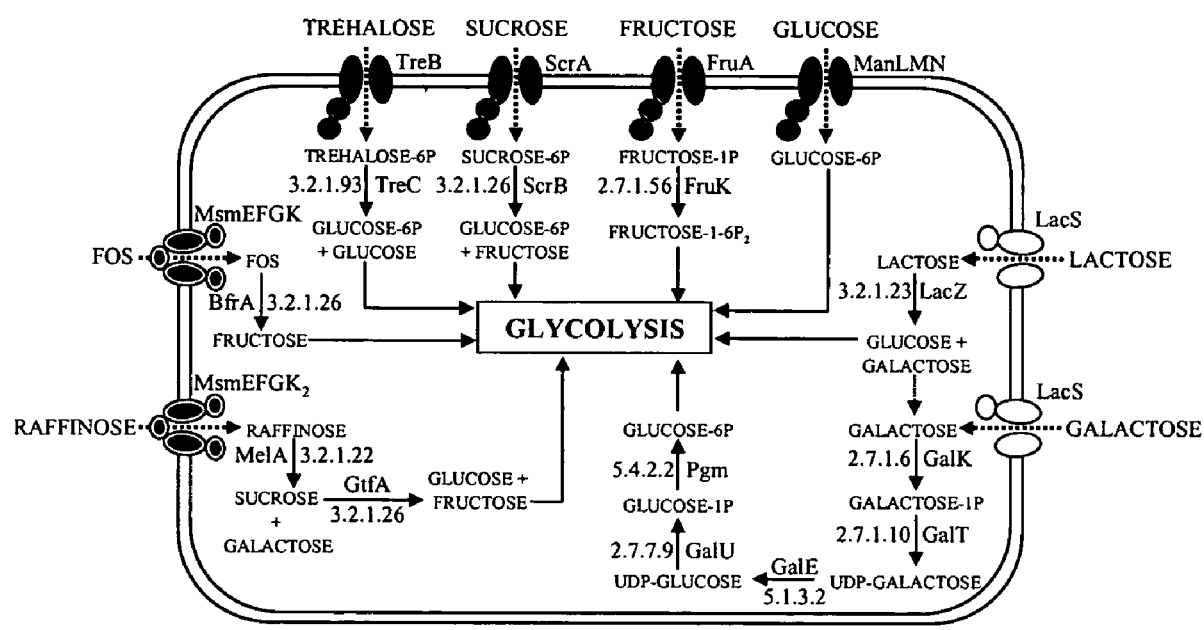
FIG. 2. Carbohydrate utilization in *Lactobacillus acidophilus*. This diagram shows carbohydrate transporters and hydrolases as predicted by transcriptional profiles. Protein names and EC numbers are specified for each element. PTS transporters are shown in black. GPH transporters are shown in light gray. ABC transporters are shown in dark gray.

A number of lactic acid bacteria take up glucose via a PTS transporter. The $EII^{Man}$ PTS transporter has the ability to import both mannose and glucose (Cochu et al. 2003). The *Lactobacillus acidophilus* mannose PTS system is similar to that of *Streptococcus thermophilus*, with proteins sharing 53-65% identity and 72-79% similarity. Specifically, the $EII^{Man}$ is composed of three proteins $IIAB^{Man}$, $IIC^{Man}$ and $IID^{Man}$, encoded by ORF 452 (SEQ ID NOS:1 and 263) (manL), ORF 455 (SEQ ID NO:165) (manM) and ORF 456 (SEQ ID NO:167) (manN), respectively (FIG. 2). Most of the carbohydrates examined here specifically induced genes involved in their own transport and hydrolysis, but glucose did not. Analysis of the mannose PTS revealed that the genes encoding the $EIIABCD^{Man}$ were consistently highly expressed, regardless of the carbohydrate source. This expression profile suggests glucose is a preferred carbohydrate, and *Lactobacillus acidophilus* is also designed for efficient utilization of different carbohydrate sources, as suggested previously for *Lactobacillus plantarum* (Kleerebezem et al, (2003) *Proc. Natl. Acad. Sci. USA* 100:1990-1995).

The genes differentially expressed in the presence of galactose and lactose included a permease (LacS), and the enzymatic machinery of the Leloir pathway. Members of the LacS subfamily of galactoside-pentose-hexuronide (GPH) translocators have been described in a variety of lactic acid bacteria, including *Leuconostoc lactis* (Vaughan et al. (1996) *Appl. Environ. Microbiol.* 62:1574-1582), *S. thermophilus* (van den Bogaard et al. (2000) *J. Bacteriol.* 182:5982-5989), *Streptococcus salivarius* (Lessard et al. (2003) *J. Bacteriol.* 185:

6764-6772) and *Lactobacillus delbrueckii* (Lapierre et al. (2002) *J. Bacteriol.* 184:928-935). Although LacS contains a PTS EIIA at the carboxy terminus, it is not a member of the PTS family of transporters. LacS has been reported to have the ability to import both galactose and lactose in select organisms (Vaughan et al. (1996) *Appl. Environ. Microbiol.* 62:1574-1582; van den Bogaard et al. (2000) *J. Bacteriol.* 182:5982-5989). Although the combination of a LacS lactose permease with two β-galactosidase subunits LacL and LacM has been described in *Lactobacillus plantarum* (Kleerebezem et al. 2003) and *Leuconostoc lactis* (Vaughan et al. (1996) *Appl. Environ. Microbiol.* 62:1574-1582), it has never been reported in *Lactobacillus acidophilus*. Even though constitutive expression of lacS and lacLM has been reported previously (Vaughan et al. (1996) *Appl. Environ. Microbiol.* 62:1574-1582), these results indicate specific induction of the genes involved in uptake and catabolism of both galactose and lactose. Operon organization for galactoside utilization is variable and unstable among Gram-positive bacteria (Lapierre et al. (2002) *J. Bacteriol.* 184:928-935; Vaillancourt et al. (2002) *J. Bacteriol.* 184:785-793; Boucher et al. (2003) *Appl. Environ. Microbiol.* 69:4149-4156; Fortina et al. (2003) *Appl. Environ. Microbiol.* 69:3238-3243; Grossiord et al. (2003) *J. Bacteriol.* 185:870-878). Even amongst closely related *Lactobacillus* species, namely *Lactobacillus johnsonii*, *Lactobacillus gasseri* and *Lactobacillus acidophilus*, the lactose-galactose locus is not well conserved (Pridmore et al. (2004) *Proc. Natl. Acad. Sci. USA* 101:2512-2517).

Although it was previously suggested that the phosphoenolpyruvate: phosphotransferase system is the primary sugar transport system of Gram-positive bacteria (Ajdic et al. (2002) *Proc. Natl. Acad. Sci. USA* 99: 14434-14439; Warner and Lolkema (2003) *Microbiol. Mol. Rev.* 67:475-490), current microarray data indicate that ABC transport systems are also important. While PTS transporters are involved in uptake of mono- and di-saccharides, those carbohydrates are digested in the upper GIT. In contrast, oligosaccharides reach the lower intestine whereby commensals are likely to compete for more complex and scarce nutrients. Perhaps under such conditions ABC transporters are even more crucial than the PTS, given their apparent roles in transport of oligosaccharides like FOS and raffinose. In this regard, the ability to utilize nutrients that has been are non digestible by the host has been associated with competitiveness and persistence of beneficial intestinal flora in the colon (Schell et al. (2002) *Proc. Natl. Acad. Sci. USA* 99:14422-14427).

Transcription profiles of genes differentially expressed in conditions tested indicated that all carbohydrate uptake systems and their respective sugar hydrolases were specifically induced by their substrate, except for glucose. Moreover, genes within those inducible loci were repressed in the presence of glucose, and cre sequences were identified in their promoter-operator regions (FIG. 3). Together, these results indicate regulation of carbohydrate uptake and metabolism at the transcription level, and implicate the involvement of a global regulatory system compatible with carbon catabolite repression. Carbon catabolite repression (CCR) controls transcription of proteins involved in transport and catabolism of carbohydrates (Miwa et al. (2000) *Nucleic Acids Res.* 28:1206-1210). Catabolite repression is a mechanism widely distributed amongst Gram-positive bacteria, mediated in cis by catabolite responsive elements (Miwa et al. (2000) *Nucleic Acids Res.* 28:1206-1210; Wickert and Chambliss (1990) *Proc. Natl. Acad. Sci. USA* 87:6238-6242), and in trans by repressors of the LacI family, which is responsible for transcriptional repression of genes encoding unnecessary saccharolytic components in the presence of preferred substrates (Wickert and Chambliss (1990) *Proc. Natl. Acad. Sci. USA* 87:6238-6242; Viana et al. (2000) *Mol. Microbiol.* 36:570-584; Muscariello et al. (2001) *Appl. Environ. Microbiol.* 67:2903-2907; Warner and Lolkema (2003) *Microbiol. Mol. Rev.* 67:475-490). This regulatory mechanism allows cells to coordinate the utilization of diverse carbohydrates, to focus primarily on preferred energy sources. CCR is based upon several key enzymes, namely HPr (ORF 639 (SEQ ID NO:177), ptsh), EI (ORF 640 (SEQ ID NO:179), ptsI), CcpA (ORF 431 (SEQ ID NO:181), ccpA), and HPrK/P (ORF 676 (SEQ ID NO:183), ptsK), all of which are encoded within the *Lactobacillus acidophilus* chromosome.

Carbon catabolite repression has already been described in lactobacilli (Mahr et al. 2000). The PTS is characterized by a phosphate transfer cascade involving PEP, EI, HPr, EIIABC, whereby a phosphate is ultimately transferred to the carbohydrate substrate (Saier, 2000; *Warner and Lolkema,* 2003). HPr is an important component of CCR, which is regulated via phosphorylation by enzyme I and HPrK/P. When HPr is phosphorylated at His15, the PTS is active, and carbohydrates transported via the PTS are phosphorylated via EIIABCs. In contrast, when HPr is phosphorylated at Ser46, the PTS machinery is not functional (Mijakovic et al. (2002) *Proc. Natl. Acad. Sci. USA* 99:13442-13447).

Although the phosphorylation cascade suggests regulation at the protein level, several studies report transcriptional modulation of ccpA and ptsHI. In *S. thermophilus*, CcpA production is induced by glucose (van den Bogaart et al. 2000). In several bacteria, the carbohydrate source modulates ptsHI transcription levels (Luesink et al. 1999). In contrast, expression levels of ccpA, ptsH, ptsI and ptsK did not vary in the presence of different carbohydrates in *Lactobacillus acidophilus*. These results are consistent with regulation via phosphorylation at the protein level. Similar results have been reported for ccpA expression levels in *Lactobacillus pentosus* (Mahr et al. (2000) *Appl. Environ. Microbiol.* 66:277-283), and ptsHI transcription in *S. thermophilus* (Cochu et al. (2003) *Appl. Environ. Microbiol.* 69:5423-5432).

Globally, microarray results allowed reconstruction of carbohydrate transport and catabolism pathways (FIG. 2). Although transcription of carbohydrate transporters and hydrolases was specifically induced by their respective substrates, these glycolysis genes were consistently highly expressed: D-lactate dehydrogenase (D-LDH, ORF 55 (SEQ ID NO:241)), phosphoglycerate mutase (PGM, ORF 185 (SEQ ID NO:243)), L-lactate dehydrogenase (L-LDH, ORF 271 (SEQ ID NO:245)), glyceraldehyde 3-phosphate dehydrogenase (GPDH, ORF 698 (SEQ ID NO:247)), phosphoglycerate kinase (PGK ORF 699 (SEQ ID NO:249)), glucose 6-phosphate isomerase (GPI, ORF 752 (SEQ ID NO:251)), 2-phosphoglycerate dehydratase (PGDH, ORF 889 (SEQ ID NO:253)), phosphofructokinase (PFK, ORF 956 (SEQ ID NO:255)), pyruvate kinase (PK, ORF 957 (SEQ ID NO:257)) and fructose biphosphate aldolase (FBPA, ORF 1599 (SEQ ID NO:259)). A glycerol-3-phosphate ABC transporter (ORF 1641 (SEQ ID NO:261)) was also among the genes that were consistently highly expressed. Orchestrated carbohydrate uptake likely withdraws energy sources from the intestinal environment and deprives other bacteria of access to such resources. Consequently, *Lactobacillus acidophilus* may compete well against other commensals for nutrients.

In summary, a variety of carbohydrate uptake systems were identified and characterized, with respect to expression profiles in the presence of different carbohydrates, including PTS, ABC and GHP transporters. The uptake and catabolic machinery is highly regulated at the transcription level, suggesting the *Lactobacillus acidophilus* transcriptome is flexible, dynamic and designed for efficient carbohydrate utilization. Differential gene expression indicated the presence of a global carbon catabolite repression regulatory network. Regulatory proteins were consistently highly expressed, suggesting regulation at the protein level, rather than the transcriptional level. Collectively, *Lactobacillus acidophilus* appears to be able to efficiently adapt its metabolic machinery to fluctuating carbohydrate sources available in the nutritional complex environment of the small intestine. In particular, ABC transporters of the MsmEFG family involved in uptake of FOS and raffinose likely play an important role in the ability of *Lactobacillus acidophilus* to compete with intestinal commensals for complex sugars that are not digested by the human host. Ultimately, this information provides new insights into how undigested dietary compounds influence the intestinal microbial balance. This study is a model for comparative transcriptional analysis of a bacterium exposed to varying growth substrates.

EXAMPLE 7

Multidrug Transporters

Microorganisms such as *Lactobacillus acidophilus* have developed various methods in which to resist the toxic effect of antibiotics and other deleterious compounds. One such method involves transporters that promote the active efflux of drugs, by which drug resistance may be affected for a particular microorganism. There are two major classes of multidrug transporters: secondary multidrug transporters that utilize the transmembrane electrochemical gradient of protons or sodium ions to drive the extrusion of drugs from a cell; and ATP-binding cassette (ABC)-type multidrug transporters that utilize the free energy of ATP hydrolysis to pump drugs out of the cell.

Secondary multidrug transporters are subdivided into several distinct families of transport proteins: the major facilitator superfamily (MFS, Pao et al. (1998) *Microbiol. Mol. Biol. Rev.* 62:1-34), the small multidrug resistance (SMR) family (Paulsen et al. (1996) *Mol. Microbiol.* 19:1167-1175), the resistance-nodulation-cell division (RND) family (Saier et al. (1994) *Mol. Microbiol.* 11:841-847), and the multidrug and toxic compound extrusion (MATE) family (Brown et al. (1999) *Mol. Microbiol.* 31:394-395. These families are not solely associated with multidrug export, and include proteins involved in other proton motive force-dependent transport processes or other functions.

MFS membrane transport proteins are involved in synport, antiport, or uniport of various substrates, among which are antibiotics (Marger and Saier (1993) *Trends Biochem. Sci.* 18:13-20). Analysis and alignment of conserved motifs of the resistance-conferring drug efflux proteins revealed that these proteins can be divided into two separate clusters, with either 12 or 14 transmembrane segments (Paulsen and Skurry (1993) *Gene* 124: 1-11). The NCFM genome contains several genes that encode MFS transporters attributed to multidrug transport. Included among these are the transporters encoded in ORFs 552 (SEQ ID NO:77), 566 (SEQ ID NO:79), 567 (SEQ ID NO:81), 1446 (SEQ ID NO:85), 1471 (SEQ ID NO:87), 1621 (SEQ ID NO:91), 1853 (SEQ ID NO:93), 1854 (SEQ ID NO:321), 164 (SEQ ID NO:309), 251-253 (SEQ ID NOs:311, 313, 315) and 1062 (SEQ ID NO:317).

ABC transporters require four distinct domains: two hydrophobic membrane domains, which usually consist of six putative transmembrane α-helices each, and two hydrophilic nucleotide binding domains (NBDs), containing Walker A and B motifs (Walker et al. (1982) *EMBO J.* 1:945-951) and the ABC signature (Hyde et al. (1990) *Nature* 346: 362-365). The individual domains can be expressed as separate proteins or they may be fused into multidomain polypeptides in several ways (Faith and Kolter (1993) *Microbiol. Rev.* 57:995-1017; Higgens (1992) *Annu. Rev. Cell Bio.* 8:67-113; Hyde et al. (1990) *Nature* 346:362-365). A multidrug ABC transporter in the NCFM genome similar to the ABC multidrug transporter lmrA from *Lactococcus lactis* and horA from *Lactobacillus brevis* is encoded by ORF 597.

All publications, patents and patent applications mentioned in the specification are indicative of the level of those skilled in the art to which this invention pertains. All publications, patents and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (324 sequences)

SEQ ID NO: 1 - DNA, 432 bp, Lactobacillus acidophilus
  CDS (1)...(432)
  misc_feature (0)...(0): ORF 452; similar to PTS system mannose-specific, factor IIAB
atggtaggaattgttttagccagccatggtggcttcgctgatgggattgcgcaatctgcacaaatgcttttcggtgaacaggataattttgcacatgttatcttaaagcctaatgaaggtccagatgatattcgtggcaaaatggaaaaagcaattgcttcatttgataaccaagatgaagttttattcttggtagacttatggggtggtacacctttcaaccaggcaaatggtcttgctgaaaaacatgataaatgggcaattgtagccggtatgaatttaccaatggttgtacaagcattaactgaaagaatgatgaatgctaatgcaactgcacatgaaattgctactgcagttgttgaacctggtaaagatggtatcaagacaaagccagcagatttgatgcctaaatcagctgctgcaccagcaggc

SEQ ID NO: 2 - protein, 144 aa, Lactobacillus acidophilus
MVGIVLASHGGFADGIAQSAQMLFGEQDNFAHVILKPNEGPDDIRGKMEKAIASFDNQDEVLFLVDLWGGTPFNQANGLAEKHDKWAIVAGMNLPMVVQALTERMMNANATAHEIATAVVEPGKDGIKTKPADLMPKSAAAPAG

SEQ ID NO: 3 - DNA, 369 bp, Lactobacillus acidophilus
  CDS (1)...(369)
  misc_feature (0)...(0): ORF 877; similar to cellobiose phosphotransferase enzyme IIA
atggcagaagaaaaacaaactccagaacaaaaggaccaagaaaccttgatggctgctatgggcttaattgcaaatggtggaaatgcaaaaagtttagcttttgaagcaattcgtcttgcaaagactggtgatatcgaaggcgcacgtgaaaagttaaaggaaagtgataagtcacttcttgaggcacacaattcacagacaagtatgcttactcaagaagcacaaggtgatcatatgcacgtgaccttattggtagtacactcacaagatcacttgatgaatgctattacctttagagatttggctggagaaatggtggatctttacgaaaagctatataattctggcgctcttaaaaaagaagataag

SEQ ID NO: 4 - protein, 123 aa, Lactobacillus acidophilus
MAEEKQTPEQKDQETLMAAMGLIANGGNAKSLAFEAIRLAKTGDIEGAREKLKESDKSLLEAHNSQTSMLTQEAQGDHMHVTLLVVHSQDHLMNAITFRDLAGEMVDLYEKLYNSGALKKEDK

SEQ ID NO: 5 - DNA, 483 bp, Lactobacillus acidophilus
  CDS (1)...(483)
  misc_feature (0)...(0): ORF 609; beta-glucoside specific transport protein; BglS
atgtttaatttctttaagaaaaagaataagggtttagaagtagttgcagtagttgatggcgatattatgcctattactgatgtaaaagatgatgttttctcaactaaaatgttaggtgatggttttgccattaaaccaaaagacagccacatttatgctcctgttgatgggactattacaacacttttcccaactaagcacgccattggtattaagactgaaaagggattagaaattttgatccacttgggacttgatacagtagaattagaaggtgctccgtttacagtagacgttaaacaaggcgatcaagtgaagaagggacaacctttagctacaatggatttcgaattgatcacggataaaggatatgatgatagttgtatcgtagtctatacgaatatggatattgttaagtcagttactccgattgaaaagggtgctgtcgaacattcccaaacagtacaaaccgttgaatttaat

SEQ ID NO: 6 - protein, 161 aa, Lactobacillus acidophilus
MFNFFKKKNKGLEVVAVVDGDIMPITDVKDDVFSTKMLGDGFAIKPKDSHIYAPVDGTITTLFPTKHAIGIKTEKGLEILIHLGLDTVELEGAPFTVDVKQGDQVKKGQPLATMDFELITDKGYDDSCIVVYTNMDIVKSVTPIEKGAVEHSQTVQTVEFN

SEQ ID NO: 7 - DNA, 873 bp, Lactobacillus acidophilus
  CDS (1)...(873)
  misc_feature (0)...(0): ORF 1479; Transcription antiterminator licT
ttgttgaaaggtatgaagatcatgatcgtaataaaaagagtactcaacaacaatgctgtcgttgcaaaagatgaacttaatcgaactttggttgcattaggcagtggtattgcttttcaacaaaaagcagggcatattatcccaaaagataaaatagaaaagattttttatcccaaggatgaagatgcaacaaattcaattagtgaaactttatcacagattgatcctaaatatattgagttgtccgatcgtattatttcagaagctatcacaagttcaggtaaaaaattatcagatgatatttatgtatctttacctgatcatttacagtttgctgttgagagagttaagaatggcattttgattcaaaataaattaactgtcgagacaatgcaaacatatccagatgaatttcagttagggaaacgtgttttaaagtatctatcagaaaaaacgggattagattttcctgatgatgaagcgacaaatattgcaatgcacttaattaccgctgaagaaggagattctttggaaaatactgagggaacgattgaattgataaatcgtttcttaaagataataagtgaaatgttaggaaagaacataaactctaattcagtatcatattatcgtttaattacacatcttaaattctttattcagcgtattaaaaaacagcagagccaaaagtttaaagcagataaagatttatatgacatggttatccatagttatcacaaagaatacattattgctcaaagaattgcaggtattgtattacatgattttaattatgaagtgtcagaagatgaagtgatgtttcttactatacatattcatcgaataaatgtatcaacaggtgactacaatgaa

SEQ ID NO: 8 - protein, 291 aa, Lactobacillus acidophilus
MLKGMKIMIVIKRVLNNNAVVAKDELNRTLVALGSGIAFQQKAGHIIPKDKIEKIFYPKDEDATNSISETLSQIDPKYIELSDRIISEAITSSGKKLSDDIYVSLPDHLQFAVERVKNGILIQNKLTVETMQTYPDEFQLGKRVLKYLSEKTGLDFPDDEATNIAMHLITAEEGDSLENTEGTIELINRFLKIISEMLGKNINSNSVSYYRLITHLKFFIQRIKKQQSQKFKADKDLYDMVIHSYHKEYIIAQRIAGIVLHDFNYEVSEDEVMFLTIHIHRINVSTGDYNE

SEQ ID NO: 9 - DNA, 1440 bp, Lactobacillus acidophilus
  CDS (1)...(1440)
  misc_feature (0)...(0): ORF 1574; similar to phospho-beta-glucosidase
atgaaaaataataaatatgagtttcctaaaaatttcttatggggtggagcattggcagcaagtcaatgtgaaggatttcctaccgaagatggagggggatattcaactgccgatgcattacctaaaggagtctttggagatataaaaattccccctgtaaaggattatttaaaaaaagaagcaattgatttttatcatcgatatcctgaagatataaaaatgtttggagaattgggattaaaaatgcttagaatttctatttcttgggctagaatttttccaaatggtgatgataaagaaccaaatcaagctgagttagagcattacgatcgattaattcaaacattaattgatcaaggaattgaaccaatgataactttagagcattttgattttccacttcatttagttacacaatatggaggatggaaaaatagaaaattaataaaattatatgctcgttttgttgagttattatttaatcgttataagaataaagttagatattggataacttttaatgaaataaatgtaactttggacgctccattcaatggagtaggactaatggatgatgctaaaaatgtgaataaaaatgatttgtatcaagcaatacataatcaatttgttgccagtagtttagctgtaaaaatagggcatgaaataaatcctgattttatgattggctgtatggttgcaaatagtccttattatccgttaacacctgatcctaaagatgttctgaaggctatggaagaagatagaaggacttacttttttactgatgtacaagctagaggaacatatcctggatatatgaaaagatattttgatgaaaataatattcattttcaaactttacctgaagatatagatttgttaaaaaaatatacggttgattatatctcatttagttattacatgagttactgcgccaccactcatgaaaaaaacaataaaaaaatccgaggaaatattcaatctgctgttcctaatccatatttagaaaaatctgattggggctggcaaattgatcctgtaggcttaagaatagcgcttaatagatattattatcgctatcaaaagccattatttgttgtagaaaatggtattggtgcacacgataagctggttaaagacaagaacggaaatataactgttaatgattcttatcggattgagtatttacaggcgcatttaaaacaagcttgggaagcaattcgagatggagtagaccttttaggttatacatgttggacgccaattgatattgtaagtaatggtgtagcggaaatggcgaaacgttatggcttaatttatgttgatcgcaacaacgatggtacaggatccctaagtagatacaaaaagagaagcttcttttggtatcaaaaggtaataaaatctaatggaacagaacttgcagaaaatatcattaaaaat

SEQ ID NO: 10 - protein, 480 aa, Lactobacillus acidophilus
MKNNKYEFPKNFLWGGALAASQCEGFPTEDGGGYSTADALPKGVFGDIKIPPVKDYLKKEAIDFYHRYPEDIKMFGELGLKMLRISISWARIFPNGDDKEPNQAELEHYDRLIQTLIDQGIEPMITLEHFDFPLHLVTQYGGWKNRKLIKLYARFVELLFNRYKNKVRYWITFNEINVTLDAPFNGVGLMDDAKNVNKNDLYQAIHNQFVASSLAVKIGHEINPDFMIGCMVANSPYYPLTPDPKDVLKAMEEDRRTYFFTDVQARGTYPGYMKRYFDENNIHFQTLPEDIDLLKKYTVDYISFSYYMSYCATTHEKNNKKIRGNIQSAVPNPYLEKSDWGWQIDPVGLRIALNRYYYRYQKPLFVVENGIGAHDKLVKDKNGNITVNDSYRIEYLQAHLKQAWEAIRDGVDLLGYTCWTPIDIVSNGVAEMAKRYGLIYVDRNNDGTGSLSRYKKRSFFWYQKVIKSNGTELAENIIKN

SEQ ID NO: 11 - DNA, 1875 bp, Lactobacillus acidophilus
  CDS (1)...(1875)
  misc_feature (0)...(0): ORF 1707; beta-glucoside permease IIABC component
atgagatatgaaaagatgaaccaggaaattctggcagcaataggcggagaagagaatatccaatcagttgtccactgcgcaactagattgagattcgtcttaaaggatgaaagtaaggctgatgataaaaaagctgaagcgattgatgggatcttacaagttgttaaaaaaggtggccaatatcaattagttatcggcaataatgttgaagatgtgtatgatgatttaatcaatatgattcatatagagactagtgacagtaataagcctaagaaaaaacagaatttatttgatgctatcattggtgctatcaccggttctattgcacctgcgataccattacttgctggtgccggtatgggtaaggttttacttttaatcttaaccatttgtcatgttttatcagataagagtcaaacttatcaactattaaacttgatttttgatactggatattatttcatgccagcttacgttggtttttcagctgcaaaaatttttaatactgacagaatgcttggtgcctttatcgggttaatgactgttcatccaagctgggttcagatcgtaactactaataaaccattccattttttaggattaccagttccattggttcaatattcgtctactttgattactgcgattctttctgtatggattatgtcttatatttataaatttgttagaaagattacgccgggcatggttaaagtcttcatggaaccgatgctcactatgttgattactggtccattagttttcttgatcattgggccaatctctaattggatttcagaaggtattggctttattgcaatgtggcttttccgcaatgctggtgtcattgctatcccaattttggctgcattatatccttggcttgtatctattggtattcacaaagctttgtctccaattagtattcaattagttgctactcaaggctttgacccaattattcgtgttgtcgcattatgttcgaatatgtctcaagctgctgcttcacttgcagtgggcttgaaaactaagaataagaagttaaagtcattagctctttcatcaagtgtaaccgcctatcttggtggtattactgaaccagctctgttcggtgttaacttaagattaaagaagcctatgtatggtgcaatgattggtggagcgattgccggtattgttgccagcttcatgaagttaaaagccttcatttatgtaacacctgcctttttaagtttaccaatgtggatttcaaagactgagaactttgttgttcaagctattatcgttattattgttgcaagtgttgccacttttattgccacttggataattggttttgatgatccaatagatgaggatcaagttaagaatgctaaaaaagaagaaaagaaaaattttgacaaagatcataaaaagcatgaattgcatgcacctgttaaaggtcaattagaagatatttcaaaagttgctgatccgacttttgctagtggggttatgggtaaagggattgctattgttcctagtgaaggaaaaatttttgcgccggaagacggtgtagttaccgcaatctttgatactcatcatgctattggattacatctaagtaatgatgccgatgtcttgattcatgtgggtattgatacggttgaaatgaaaggaaaaggttttaaacaactggtccaaaagggagacaaagttaccgccggtcaagaattacttgatttcaatattgatgaaattaaaaagaatggttatgatccgactgttgttatgatcgtaactaattctaaagattttttagaagtacttactgtattaaaggataaagatgcaactaaagaagttaccaaccaagataatgtaataattttagct

SEQ ID NO: 12 - protein, 625 aa, Lactobacillus acidophilus
MRYEKMNQEILAAIGGEENIQSVVHCATRLRFVLKDESKADDKKAEAIDGILQVVKKGGQYQLVIGNNVEDVYDDLINMIHIETSDSNKPKKKQNLFDAIIGAITGSIAPAIPLLAGAGMGKVLLLILTICHVLSDKSQTYQLLNLIFDTGYYFMPAYVGFSAAKIFNTDRMLGAFIGLMTVHPSWVQIVTTNKPFHFLGLPVPLVQYSSTLITAILSVWIMSYIYKFVRKITPGMVKVFMEPMLTMLITGPLVFLIIGPISNWISEGIGFIAMWLFRNAGVIAIPILAALYPWLVSIGIHKALSPISIQLVATQGFDPIIRVVALCSNMSQAAASLAVGLKTKNKKLKSLALSSSVTAYLGGITEPALFGVNLRLKKPMYGAMIGGAIAGIVASFMKLKAFIYVTPAFLSLPMWISKTENFVVQAIIVIIVASVATFIATWIIGFDDPIDEDQVKNAKKEEKKNFDKDHKKHELHAPVKGQLEDISKVADPTFASGVMGKGIAIVPSEGKIFAPEDGVVTAIFDTHHAIGLHLSNDADVLIHVGIDTVEMKGKGFKQLVQKGDKVTAGQELLDFNIDEIKKNGYDPTVVMIVTNSKDFLEVLTVLKDKDATKEVTNQDNVIILA

SEQ ID NO: 13 - DNA, 2025 bp, Lactobacillus acidophilus
  CDS (1)...(2025)
  misc_feature (0)...(0): ORF 725; PTS system, beta-glucosides-specific IIABC component
ttgagtagcttgggtttttattttgaggaggatatcatggctaagaactatgatcaattagctaaaaccatcatcaaagatgttggtggcaaagataatgttaatagcgttgtgcactgtgctacacgtttgcgtttcaagttgaaagatgaaaaaaaggctgacgatgatgccttaaaaaatacagacggtgttgttacagtagttaaggctggtggacaatatcaagttgttatcggaaacgaggttgccgatgtatatgatgcagtcttaaaagaaggcggcttctcaggcggtggcgaagttcctgatgactatagtgaagatgataattcaagttttgtcgataaagccgtcgccttaatttcaggtatttttaccgatattttagctccgcttagtgctggaggtatcatcaaaggtttagttgttttagctgcagctatgggttggctttcaacttcatctggtgcatatcaaattttatatgcaattggtgatagcattttttacttcttaccaattttcttgggagtaacggctgccagaagattccacatgaatcaatttattggtttagcaatcggtgctacattgacatacccaacaatggtgcaattagctgcaagtaagactgttttaggaacactttttgctggtacaccatttgcttcacagattcatacgactttctttggtattccagtaattacaatgaattatacttcaactgttttgccagttttattcgcagtttggtttgcttcaattattgaacattggtctaagaagtggattccaagcgtagttcaaatgtttttggtacctgtagttactatgattataactttgccaattgcctttattgtaatcggtcctgtaatgacctgggttgggaatgcaattggtgctgtaatgtcaggtatttaccactttagtccaattattgccggtctacttttaggtggactttggcaagtattggttatcttcggtgttcactgggggatcgttgccgtaactacagccgatttagctgctcttggttatgatccaattttaggtatgacttgcatggtctgctacgcacaaatcggggttgttttagctattattaaacaaaccaaagataagaaacttaaagaaaacgctactggtgcattcttctcaggactctttggtgtaactgaaccagctatttatggtattactttgccaagaaaacgtccatttgttttaagttgtattgctggtgctgtttcaggtgcgattatcggtgccttccattcagttttatacattttaccttcaatgggtttctttgcaattcctgcctacattaaccctaaagggggttcaatgactcaaattatcggcgtaattattgccggagtagttgcttttatagttggttttgctttacaaatgctctttggtaaaaagtcagtagatgcaaaatatgataaaaagcaaactgaaaaagtagaagtaaatgaaactttacaaacgactccagatgttgctactgctacattggctagcccagaaaatggtcaaattatgccactttcagaagttaaagatgacgtattttcaagtggtgcaatgggtaagggaattgctattgaaccaagtgatggggttcttcatgcacctgcagatggtaagatcattatgacctttaagactggtcatgcaattggtatgaaaactaagaacggtgcagaaattttaatgcatattggtatggatactgcgaatcttcaaggtaaaggttttgatactttggtagaaaaagatcaaaaagttaaagctggcgatccattaattaagtttgatattgatttaattaaaaaggctggttaccctgtaaccacacctatggtagtaactaattcacaagactttgatgatattaaacagattgttaaaggtgaagtaaaggtaggacaagctgtactcgaacttgaagctcctgaggcaaaggatgtaactacatcagttaatggacaagtgcaattaaat

SEQ ID NO: 14 - protein, 675 aa, Lactobacillus acidophilus
MSSLGFYFEEDIMAKNYDQLAKTIIKDVGGKDNVNSVVHCATRLRFKLKDEKKADDDALKNTDGVVTVVKAGGQYQVVIGNEVADVYDAVLKEGGFSGGGEVPDDYSEDDNSSFVDKAVALISGIFTDILAPLSAGGIIKGLVVLAAAMGWLSTSSGAYQILYAIGDSIFYFLPIFLGVTAARRFHMNQFIGLAIGATLTYPTMVQLAASKTVLGTLFAGTPFASQIHTTFFGIPVITMNYTSTVLPVLFAVWFASIIEHWSKKWIPSVVQMFLVPVVTMIITLPIAFIVIGPVMTWVGNAIGAVMSGIYHFSPIIAGLLLGGLWQVLVIFGVHWGIVAVTTADLAALGYDPILGMTCMVCYAQIGVVLAIIKQTKDKKLKENATGAFFSGLFGVTEPAIYGITLPRKRPFVLSCIAGAVSGAIIGAFHSVLYILPSMGFFAIPAYINPKGGSMTQIIGVIIAGVVAFIVGFALQMLFGKKSVDAKYDKKQTEKVEVNETLQTTPDVATATLASPENGQIMPLSEVKDDVFSSGAMGKGIAIEPSDGVLHAPADGKIIMTFKTGHAIGMKTKNGAEILMHIGMDTANLQGKGFDTLVEKDQKVKAGDPLIKFDIDLIKKAGYPVTTPMVVTNSQDFDDIKQIVKGEVKVGQAVLELEAPEAKDVTTSVNGQVQLN

SEQ ID NO: 15 - DNA, 1335 bp, Lactobacillus acidophilus
  CDS (1)...(1335)
  misc_feature (0)...(0): ORF 491; PTS system, cellobiose-specific IIC component
atggcaaacaaaaaaacaagtggaggtttaaatgcgttcgttaatgagcatattatgccagtggccgctaaaataggtaacttcaaacccttaattgctgttcgtgatggtattgcaatggcaatgcctttgatcattgtgggatcgttattcatgatcattaactccttcccagttccaggctggtctgactggctagctaaaacagcagtgcatggtgtgagtttatcccaaattatggctaaaattaccaatggatcatttgggattatggggctgattgctgcctttggtattgcatggagttatgctaaccaacataaaaccgacggtgtatcagctggcattatttcagcatcagtattctttattcttacaccaagtattatgagtggagacaaagttcctgtagaaggattcccttatacttatttaggtagtagaggtctatttgtagctattatttttggtcttttgagtgcatggattttccaatggttcattaaccataacatccaaattaagatgccagaaactgtaccacctgctgtagctaagagtttttcagctttaattccaggtgctgtagtaattgcaattgccggttgcgtttactggctatttgcttggactggctggggtaatattcatgatgtaattatgaatattttggctaagccgttaggtgccttgggtaatactttgattggtactttagtatctattatattggtaagtttattctggtttgttggtatccatggcggtaatgttgttaacacagctatgcaaccaatctggttaatgcaaactgatgctaatcgtgtattaaatcaagcgggtcatctagatttggcacacggtggtcacattattactcaaccatttattgataactttgtatacatgggtggtggtggtgccactatcggtttagtactttgcattggttacttagtatggcgtaaacgtgcaagtaagcaaaatgaagttttggcaccattaacaattgttcctggcttatttaatattaatgaaccaacaatgtttggtttgccagttgttttaaacttaagtctaataattccatttattcttgcgccaatggttaatgcaattactacttatatcgctatgaatttaggcttagttccattatgtaacggtagtgttggtccttggactatgccaccaattatttctggatttttagcaaccggtagtattgcaggatcaattttgcaattaatcaatattgttttagacatcttaatttacttgccattcatggcagcattaaataaacgtcagattgtagaagaaaatgaggcaaaa

SEQ ID NO: 16 - protein, 445 aa, Lactobacillus acidophilus
MANKKTSGGLNAFVNEHIMPVAAKIGNFKPLIAVRDGIAMAMPLIIVGSLFMIINSFPVPGWSDWLAKTAVHGVSLSQIMAKITNGSFGIMGLIAAFGIAWSYANQHKTDGVSAGIISASVFFILTPSIMSGDKVPVEGFPYTYLGSRGLFVAIIFGLLSAWIFQWFINHNIQIKMPETVPPAVAKSFSALIPGAVVIAIAGCVYWLFAWTGWGNIHDVIMNILAKPLGALGNTLIGTLVSIILVSLFWFVGIHGGNVVNTAMQPIWLMQTDANRVLNQAGHLDLAHGGHIITQPFIDNFVYMGGGGATIGLVLCIGYLVWRKRASKQNEVLAPLTIVPGLFNINEPTMFGLPVVLNLSLIIPFILAPMVNAITTYIAMNLGLVPLCNGSVGPWTMPPIISGFLATGSIAGSILQLINIVLDILIYLPFMAALNKRQIVEENEAK

SEQ ID NO: 17 - DNA, 1266 bp, Lactobacillus acidophilus
  CDS (1)...(1266)
  misc_feature (0)...(0): ORF 1369; similar to PTS system, cellobiose-specific IIC
atggaggattacctcatgcaaaatagtaagttcatgaattggacgaggcaaaagttaatgcctgccttaggaaaaatgggcgaaaacaaatatatggttgttttaagagatgggatgattatttcagttccatttactatcttcggttctatctttatgatcattgccaacttgcctgtgccaggttggtcaaatatcattaagccttatcttccagtattaaatgcgccaattaatatgtctactggtttgattggtttaattattgcacttggtatttcatatactttagcccgtgaaaataagattgatcgtctatctgcatcagtaattggtgctattgcttttattatttgcgaattgaacaataaaatggtccttgatcctacaaacttaggagcttcaagtatgttcactgctatcgttgtttcacttatcggtggcgaaatttataactggtttattaagcataaaattgttattaagttaccggattcagttccacctgcagtagctagttcatttgtctcattaattcctgcattagcaattttaggtggcgcttgggttattagatgtctgcttcatttagatatcaatgcctttattacctggatcttctcacctcttactgctactctgggtagtttctggggaatggaactgtttactttcttcacactttttgcttggactattggtatccatggtaataatactgttggtattgtagctggtcctgtttatggtaattttttaatggacaatatgcataaagctatgaacggtggcgtacccactcacatttgtgctgatggtttcttaacttttggtatggcaatgggtggtaccggtgctgttctcggattagtaatttgtatgttatttgccaaaagtaagcgttataaacaattagctcacttaggtttcgttccatgtattttccaaatttctgagcctattatgtttggtgtccctgttgtattaaatcctacccttgcaattccatttattactattcctttggtattacaagcaatctcttatttcttatttaaattccatatcttacatatgatcattgccagtgttccttggactactccaactttacttaatggtttcttgattactggtggtgattggaaagccgttgtatggcaagctatctgtgtattaatcgcagttgcaggttactggccattcttcaaaattttggataaaaaagctttagcagttgaacaaggcgaaactgctcccgaagaa

SEQ ID NO: 18 - protein, 422 aa, Lactobacillus acidophilus
MEDYLMQNSKFMNWTRQKLMPALGKMGENKYMVVLRDGMIISVPFTIFGSIFMIIANLPVPGWSNIIKPYLPVLNAPINMSTGLIGLIIALGISYTLARENKIDRLSASVIGAIAFIICELNNKMVLDPTNLGASSMFTAIVVSLIGGEIYNWFIKHKIVIKLPDSVPPAVASSFVSLIPALAILGGAWVIRCLLHLDINAFITWIFSPLTATLGSFWGMELFTFFTLFAWTIGIHGNNTVGIVAGPVYGNFLMDNMHKAMNGGVPTHICADGFLTFGMAMGGTGAVLGLVICMLFAKSKRYKQLAHLGFVPCIFQISEPIMFGVPVVLNPTLAIPFITIPLVLQAISYFLFKFHILHMIIASVPWTTPTLLNGFLITGGDWKAVVWQAICVLIAVAGYWPFFKILDKKALAVEQGETAPEE

SEQ ID NO: 19 - DNA, 390 bp, Lactobacillus acidophilus
  CDS (1)...(390)
  misc_feature (0)...(0): ORF 1684; similar to PTS system, fructose-specific IIA
atggaacttttaattgcaactcatgaaggtttggcatcaggtttactttctgcacatgatatgcttgcgggtaaaaatgatcaaattgctacaattgagcttgatgatagaggaatcagaaatttccgtgaacgttttgctgaaataatgaaaagatatgagccaggtcgtgtattaattttgaccgacttaaagaatggcacacctcacttagttgccaaagaatatgaaaaagctaatccggaaagagttcgtgtagttagtggtgttaacttaccaatggttctggagcttagccgaaaattgattaatgtttctttggacgcttccgctgagaaggccattagtattggtagagaagaaattgaagttgataaacctcaattagta

SEQ ID NO: 20 - protein, 130 aa, Lactobacillus acidophilus
MELLIATHEGLASGLLSAHDMLAGKNDQIATIELDDRGIRNFRERFAEIMKRYEPGRVLILTDLKNGTPHLVAKEYEKANPERVRVVSGVNLPMVLELSRKLINVSLDASAEKAISIGREEIEVDKPQLV

SEQ ID NO: 21 - DNA, 486 bp, Lactobacillus acidophilus
  CDS (1)...(486)
  misc_feature (0)...(0): ORF 146; PTS system, galactitol-specific enzyme II
atgactaattcaaaaaaattttttgtgcctgatgctgtgtttgtagtagatcaatttgaccaagatcaagttcttaaagtgatttatgataaattgcttgaactaggatatgtaaaaggtgatttcttatcccacattattgaaagagagcataactttccaacaggattagatactgataccttaggtaaagatatccctaatattgcgattcctcatacagaaggtgaatttgtgaatactcgtcttattgttccggttgcattaaaaaatccggttatttttcataatatgatcaaaccagatgaaatactagaagtgaaatttttatttatgcttttgggcaataatccagatgggcaggctagtttattggctagtgtaatgcgctttttagctaacacgccagcaaatgaattacgagaagtatttaactttacgaattccgaagcaatatatgaatttttagaacaaaaatttgttaaa

SEQ ID NO: 22 - protein, 162 aa, Lactobacillus acidophilus
MTNSKKFFVPDAVFVVDQFDQDQVLKVIYDKLLELGYVKGDFLSHIIEREHNFPTGLDTDTLGKDIPNIAIPHTEGEFVNTRLIVPVALKNPVIFHNMIKPDEILEVKFLFMLLGNNPDGQASLLASVMRFLANTPANELREVFNFTNSEAIYEFLEQKFVK

SEQ ID NO: 23 - DNA, 1398 bp, Lactobacillus acidophilus
  CDS (1)...(1398)
  misc_feature (0)...(0): ORF 227; PTS cellobiose-specific component IIC
ttgtttttatgtaatcgtttacatagaatgataattgttaagagaaaagaacaattaaagattgggagagaacttatgaaaaactttattaacacgcgcgtcttaccgccgataatgaaatttgttaacacaagaccaatcgttgcattaaaagatggtatggttatatctttgccatttattatgatcggttcagtatttttacttcttgcttcatttccagttccagcagttgctaactggatggatgcaatggggttaactagattctggacgcaagcttataatgcttcatttggaattgtttcagtatttgcagtaattggtattgcatatcaatgggcaaaaagtgaaaaagtagatccacttccatcaggattaaccgcatttgttggctttttaattattatgaatccgactagcgctgtaatgaatggttcaaaaactattgtttcagctaatcaagcacctaatttattaagtggctatattgatcgcgtttggcttggtggtcaaggtatgattgccgcaattattattggtttgattactggatggatttattcatggtttattaagaaaaagattaccattaagttaccagatcaagttccaccagcagtagcaggttcatttgttgctttgattccagcggcagttatttccacattatggctatgtgtatacattttctttgaaaaagttgctaacactacattgactcaatggatctatgctactatccaaacaccacttcaaggtatttcagattcattcggtggtatcttgattatgactattttagtaccattcttttggttctttggtgttcatggttcaacacttgttggtggtattgttggtccaattttacaagctaatgcattggaaaatgctgctatttttaagaaatttggctatgtagatgcagaacacggtggtcacattgttattcaggggttatttgatcaattttctactgtaactggtgcaggaatgactattggacttgttgtattcatggtcttctttgctagatcacaacaacttaagagtattggtaaattaaccttggtgccaggtatctttaatattaatgagccggttttgttcggtgttcctattgttatgaacccaatgttggctattccattcttcatcatgccacctttatcagcaggttcaacttacttattaattaaagctggtattctaccataccttaacggtgtacaagtaccatggaccactccaccagttatttcaggattcttaattggtggatggaagatagctctttggcaggcaataattttagtaatttccttctttgtttattggccatttgctcgaagctatgacaagatgctctacaagcaggaacaacaagctaaaaaa

SEQ ID NO: 24 - protein, 466 aa, Lactobacillus acidophilus
MFLCNRLHRMIIVKRKEQLKIGRELMKNFINTRVLPPIMKFVNTRPIVALKDGMVISLPFIMIGSVFLLLASFPVPAVANWMDAMGLTRFWTQAYNASFGIVSVFAVIGIAYQWAKSEKVDPLPSGLTAFVGFLIIMNPTSAVMNGSKTIVSANQAPNLLSGYIDRVWLGGQGMIAAIIIGLITGWIYSWFIKKKITIKLPDQVPPAVAGSFVALIPAAVISTLWLCVYIFFEKVANTTLTQWIYATIQTPLQGISDSFGGILIMTILVPFFWFFGVHGSTLVGGIVGPILQANALENAAIFKKFGYVDAEHGGHIVIQGLFDQFSTVTGAGMTIGLVVFMVFFARSQQLKSIGKLTLVPGIFNINEPVLFGVPIVMNPMLAIPFFIMPPLSAGSTYLLIKAGILPYLNGVQVPWTTPPVISGFLIGGWKIALWQAIILVISFFVYWPFARSYDKMLYKQEQQAKK

SEQ ID NO: 25 - DNA, 1284 bp, Lactobacillus acidophilus
  CDS (1)...(1284)
  misc_feature (0)...(0): ORF 989; PTS system, lactose-specific IIBC components
atgaaaaaggggatttttatgaatgaggataaaatagttagttggcttgttaagtacaaacaattaacttttataaaaatcttacaacagacaatggtctcgctctttcctgttgctttgattggaacatattgttggacattggttaatagttgtttaacgacaaatagtttttttggtcgtttaaccaatataaccaaatggtttccagatcataattttgctagtgcaatagttaatgatgttagtttagctacaacgggaatttttgcactttatgcggcatttgtcagtgcagaactaacaatgcgacattatggaaaagcttctagtattgtaggtatagcaagtgtttcgtcatatatattgatttttgttcatactattcgcaatactcaacgagtggaaatgagttattatggtgcgacttggttcatttgcggtattattgtggggtattttgtaggattagtttttgctaaagtagggcatgatattccgcgtattaaagatcgagatattattaaagaaatttttattaatattcgtcccatgttaattgtgttagctgtggcattattgattcatttagcttttgcaacatatcggcaatatcaaatggatcgtatagttgctcaaagtgtatcaactgtagctaatcaacatagtagttatggcctatcaattttgatatctttaattactgcctttactatgtggttaggatatgctggaacattaaactttagtagtaatatttttggtagtgaatctattgctaatttgtcatatgcgttatcccataagacaccttggaatatcccgtatccttttaccttacaagcactttttaatggatttggaaaaattggtggagttggcgctacactagctttagtcattgctttgattttacttagtaatagaaagcaaaagcaaaaagttgcattagctagttctgtacctgttttttttaacgttaattttgctttagtattgggtataccaacaattttgaatccaatttatttaataccatttgttttaacgccaattgtgaatatgtttttaggtagtattgcaatcttacttaaaatgtttccaccattagtttatccagtaccagatggtctaccaggtattttgggacctttaatgggaactggcggaaataatttagctttgatttatacaattttcattttaatagtagatgtttgtatctatctaccttttgttaaattagataataaagtcgctgataaatacgaggaaagtttaaaa

SEQ ID NO: 26 - protein, 428 aa, Lactobacillus acidophilus
MKKGIFMNEDKIVSWLVKYKQLTFIKILQQTMVSLFPVALIGTYCWTLVNSCLTTNSFFGRLTNITKWFPDHNFASAIVNDVSLATTGIFALYAAFVSAELTMRHYGKASSIVGIASVSSYILIFVHTIRNTQRVEMSYYGATWFICGIIVGYFVGLVFAKVGHDIPRIKDRDIIKEIFINIRPMLIVLAVALLIHLAFATYRQYQMDRIVAQSVSTVANQHSSYGLSILISLITAFTMWLGYAGTLNFSSNIFGSESIANLSYALSHKTPWNIPYPFTLQALFNGFGKIGGVGATLALVIALILLSNRKQKQKVALASSVPVFFNVNFALVLGIPTILNPIYLIPFVLTPIVNMFLGSIAILLKMFPPLVYPVPDGLPGILGPLMGTGGNNLALIYTIFILIVDVCIYLPFVKLDNKVADKYEESLK

SEQ ID NO: 27 - DNA, 1425 bp, Lactobacillus acidophilus
  CDS (1)...(1425)
  misc_feature (0)...(0): ORF 884; cellobiose-specific PTS system IIC component
atggctgatcaaaaacaatcaggatttagcagttttgttaataacaaaattttgcctcctgtaatgaaatttgttaacacgaaagctattactgcattacaaaatggtatgatttatactttaccatttattatcattggttctattttcttaattttaggaaatattccaattcctgcagtatcaaatgcgattaatgcttctggttggggagcaatctttaaccaagcttacacaacaacattctcagtaatgtcactttgggcatcaattggtatcgcctatatttacgttaagaatgagaatttggaaccattagcaccaggtcttacatcctgtgctgcattcttaatgcttcaaactttatcaattgctagtcctgttaaaactgctttaagcagtggtattcctaatggtatgaatgctaaagcatttactgctgctattagcgaattaccaaaagctgttcaaacttatattgaacaacctgttaccggtgtatttaacatcacttggcttggtggtgacggtatgatcgccgcaatcatcatcggtcttcttgttggttggatttacagtgctattgttaaaaaaggttggactattaagcttcctaagcaagttccacctgcagtttcaaaccaatttactgctatgattcctgcaggtattatcttaatcggttcaatgcttatctacgcatgcttcaacttatttgcacatactgacttcttgcaatggacttataacactattcaaactccattacaaggtatctcagactcatttggtggtgctcttgctattggtttccttgttccattcttctggttctttggtgttcacggtggtttgattgttggttcacttgctggtcctatgcttcaagctaactcattcgataacgctcaattatacaaagctggtaagttaactattgctcaaggtgcacacgttgttaccaacgaattctacaacaactttattaatttaactggttcaggtattactattggtttaattatcttcattcttgtcgctgccaaatcagctcaattgaagtcaattggtaaattggaattagtaccaggtatctttaacattaatgaaccattcctcttcggtttaccaatcgttatgaacccattccttgctgttccattcttcttaactccagtagttgttgcagcttcaacctacttagtaattagaactggtattattccaccacttaacggatttgctgctccttggacaactccagcaattatttccggtttcttaatcggtggttggaagatggctatctggcaagcatgtactttggtaatttcaacacttatttactggccatttgctaagaagtacgataacgttcttgttaaacgtgaagctgctaaaaaggctcaagaagacgctgccaag

SEQ ID NO: 28 - protein, 475 aa, Lactobacillus acidophilus
MADQKQSGFSSFVNNKILPPVMKFVNTKAITALQNGMIYTLPFIIIGSIFLILGNIPIPAVSNAINASGWGAIFNQAYTTTFSVMSLWASIGIAYIYVKNENLEPLAPGLTSCAAFLMLQTLSIASPVKTALSSGIPNGMNAKAFTAAISELPKAVQTYIEQPVTGVFNITWLGGDGMIAAIIIGLLVGWIYSAIVKKGWTIKLPKQVPPAVSNQFTAMIPAGIILIGSMLIYACFNLFAHTDFLQWTYNTIQTPLQGISDSFGGALAIGFLVPFFWFFGVHGGLIVGSLAGPMLQANSFDNAQLYKAGKLTIAQGAHVVTNEFYNNFINLTGSGITIGLIIFILVAAKSAQLKSIGKLELVPGIFNINEPFLFGLPIVMNPFLAVPFFLTPVVVAASTYLVIRTGIIPPLNGFAAPWTTPAIISGFLIGGWKMAIWQACTLVISTLIYWPFAKKYDNVLVKREAAKKAQEDAAK

SEQ ID NO: 29 - DNA, 1323 bp, Lactobacillus acidophilus
  CDS (1)...(1323)
  misc_feature (0)...(0): ORF 618; similar to PTS system, cellobiose-specific enzyme IIC
atgaatcgattagttagatggttagaagattatgttttacctatagctagtcggttgggacggattagatggttggtagcattaagggatgcttttgtatctttgatgccaatcacgatcgcggggtcattggccgttttaattaagagcttaatagaagcagctcaaactcatttgagctggactacttttgcttttgcaatgcagccattggtttcaattagtaatttagtatggcgaggtacattttcgctatttgcttttttctttgcattagcgcttggctatcaattagctaaatcttttgaaggaaatcggctagcagcggcacttgtttcgctgtcttcatttgcattaagtattgctagtgtagctaaaattaaatttcatggtgatagcgtcacaataaaaaatgcatttgatattagccaattttcaactactggtctatttacagctattttatttggatcgattggttttgcaatatatttggcttgttataaggctagaataatgcttcatttatccgctaatatgccacatgcagagcaagccgcttttgattcactaattccagcaatgattgcaatttttggtgtaggtggtgttaattatctgttccaaactttaacaggtgagtattttggcacttggttactaaatagtattcaacttcctttggttaaatgggggcaaggctttggtactgtgcttttggttacgttgcttgttcaggtattttggttctttggaattaatggacttggagttttatcaccaattcttgattcaatttggctaactgcacaaaacggtaatattactgcgattaagaatggtcatgttcccccttatgtttgggtacgtggctcatttgacgtatttgcatggtttggaggcgccggtggtacattaatgttgattgttgcaatattgattttttcaaaaagaagtgactaccgtacaattgccaaaattgccttagcgccaggaatttttaatattggagaaccaattttgttgggcttacctgtagtgttaaatccagtttatttgattccatttttgttaacgcctgtagttaacgtggcattttcatattgggtaagcatcatgggattggttaatccggttcaagtagccgtgccaagtgtaatgccgccaattattggaccgtttttagcatgtaattatgattggcgagcaattgttttaagtattataaatatgttaatagcacttgctatttggactccttttgtaattgcggctgataaaattgccaataataatcctaagaaattttttatgactcaattc

SEQ ID NO: 30 - protein, 441 aa, Lactobacillus acidophilus
MNRLVRWLEDYVLPIASRLGRIRWLVALRDAFVSLMPITIAGSLAVLIKSLIEAAQTHLSWTTFAFAMQPLVSISNLVWRGTFSLFAFFFALALGYQLAKSFEGNRLAAALVSLSSFALSIASVAKIKFHGDSVTIKNAFDISQFSTTGLFTAILFGSIGFAIYLACYKARIMLHLSANMPHAEQAAFDSLIPAMIAIFGVGGVNYLFQTLTGEYFGTWLLNSIQLPLVKWGQGFGTVLLVTLLVQVFWFFGINGLGVLSPILDSIWLTAQNGNITAIKNGHVPPYVWVRGSFDVFAWFGGAGGTLMLIVAILIFSKRSDYRTIAKIALAPGIFNIGEPILLGLPVVLNPVYLIPFLLTPVVNVAFSYWVSIMGLVNPVQVAVPSVMPPIIGPFLACNYDWRAIVLSIINMLIALAIWTPFVIAADKIANNNPKKFFMTQF

SEQ ID NO: 31 - DNA, 1878 bp, Lactobacillus acidophilus
  CDS (1)...(1878)
  misc_feature (0)...(0): ORF 606; phosphotransferase system (PTS) arbutin-like enzyme
atgatgcaaaagatccagcggtttggggccgcaatgttcgtcccagttatgctgttctcatttgcgggtattgtcgtagctttaggaagtttgttcaataacccgactctgtttggctctattgccaatccaggaacaacatggaattcagtttgggacacaatttcagctggtggttggactgtcttcaaccaagaaggtattttgtttacggtaggtttaccaatcggtttagctaataaagccagaggtagagcagctatggagtcagtaattgcttacttgacttataactactttatcggtgcaatgcttactcactggggtgcagcatttggtattcctaattttgataagattcaaattgttgctaactctactaaccatggtttgactaacattgctggtattaagactcttgatactagtatcttagctgctttggttgttgctttgatcgttgtatggttacacaataaatacttcgacaaaaaattacctgactggcttggtactttccaaggttcaacttatgtttatgcaattagtttctttgtaatgattcctttggcactcattacttgttggggttggccaaaagttcaaatgggtatcaccggtatgcaacacttcatcgtagatagtggatttatcggtgtttggatttaccaattcttgaaccgtgtattgattcctaccggtcttcaccacttggtatatattccattccaattcggtccagctgtagttgctggtggtcttcaaccatattggttaaagcaccttgcagaatacgcagcaagtacaaagccactttcacaaattgcttctgttgaaggattccaactttacggtaatgaaaagatcttcttagttccatttatctgtcttgccttttacgcaactgctaaaaagaataagaagaagcaaacatctgctttgcttattccagcagctttaacttcagttttagctggtattaccgaacctatcgactttacttatttgttcgccgcacctgtactttgggtcgtttactcagtgttatcagctactatgaacactgtaatgtgggcatttggtttaagaggatttatgtcagatggtgcaattggtattgcatcaatgaactggttgccactttgggaacaccattggcaaacatatgtaatgcaatttatcgttggtattatcttcggtattattacttactttgtattcaagattatgattgaaaagtttaactacattactccaggacgtgaagctgatgaccaggatgttaagcttattaacaagaaagaatacaaacagaagatggctgccaaagcagcaggtaaggatgcaaatgatccttacattgcaagagctacagcttaccttgacttgttaggtggtccttcaaacattaccgaattgagctcatgtgctactagattacgtgtatctgttgctgatccaagtaaggttgcaccagatgcagactttaaagcaaataaagctgttaatgttgttcaccatggtaaggcattacaagttattgtaggtcttgatgtgccacaagttcttgatgaaatgacacaattgatgcaacaaagcggtaatgaagcaaaggtttcaactgaaccagataatccatatattgaaagagcaacaggtattgttgacctgcttggcggtggtgaaaacattaaagatgtaattgcttgctcaactagagtaagagctcatgtctttgatcctaagaaagttgctccagattctgaattcaagaagattgcagattcatatgaagtccaacataaggataacaatgaaattgacattgttgttggattagatgccgatcaagttgttgatcaaattaaacaattacta

SEQ ID NO: 32 - protein, 626 aa, Lactobacillus acidophilus
MMQKIQRFGAAMFVPVMLFSFAGIVVALGSLFNNPTLFGSIANPGTTWNSVWDTISAGGWTVFNQEGILFTVGLPIGLANKARGRAAMESVIAYLTYNYFIGAMLTHWGAAFGIPNFDKIQIVANSTNHGLTNIAGIKTLDTSILAALVVALIVVWLHNKYFDKKLPDWLGTFQGSTYVYAISFFVMIPLALITCWGWPKVQMGITGMQHFIVDSGFIGVWIYQFLNRVLIPTGLHHLVYIPFQFGPAVVAGGLQPYWLKHLAEYAASTKPLSQIASVEGFQLYGNEKIFLVPFICLAFYATAKKNKKKQTSALLIPAALTSVLAGITEPIDFTYLFAAPVLWVVYSVLSATMNTVMWAFGLRGFMSDGAIGIASMNWLPLWEHHWQTYVMQFIVGIIFGIITYFVFKIMIEKFNYITPGREADDQDVKLINKKEYKQKMAAKAAGKDANDPYIARATAYLDLLGGPSNITELSSCATRLRVSVADPSKVAPDADFKANKAVNVVHHGKALQVIVGLDVPQVLDEMTQLMQQSGNEAKVSTEPDNPYIERATGIVDLLGGGENIKDVIACSTRVRAHVFDPKKVAPDSEFKKIADSYEVQHKDNNEIDIVVGLDADQVVDQIKQLL

SEQ ID NO: 33 - DNA, 1989 bp, Lactobacillus acidophilus
  CDS (1)...(1989)
  misc_feature (0)...(0): ORF 1705; sucrose-specific PTS system IIBC component
atggaaaaggataaatatcaacgcctgagtgatgaaatctatgcacaaataggtggcatagacaacgtcgaatctattattcactgtatgactcgtctaagaattaaaatacgtgatatgtcaaaagtgaatattactgcgttaaagaagattgacggtgttttaggtgttgttgaagcagatactttagaaatcgttcttggccctggggttaataccaaggtagctaagatcatgaatgacaaggcaggggttaaagaaggcgaaattttcccagctaattcttaccaagctaataaaagtgaagtagagagaaaggctgcggaagttcatgctgcacacaaagcctcacttaaacagacttggtggagagctgccttacaacacatttcagcaatttttgttccattaattccagcttttgttggtgccggtttaatttcaggtgtagcaggtattttaagaaacatgctcactgcgaaaatgttgccaggttcttggaacttaggtgttactgttttagcaatgatttcaagtgcgctttttgcttacttgaatatttatgttggtattaatactgctaaagaatttggtgctacaccaggcttgggtggtatcatcggcggtattgtatacttgccaggtattgttgctccggtaactattcctaatatttttgatggtaagccactggctgctggtcaaggtggtatcattggagttctacttggagtatggctcttatcttatgttgaaaaattcttccataaacatatagccgattcggtagatattatctttactcccttcttaactattctaataatggggctgtttacagtatttctcattatgccattggctggatggttctcaaattcattagtcggcgcaattaattgggtacttaaagttggtggacctgtttctggttttatcctcgggctattcttcctacctatggtaatgctgggactacaccagattttgacaccaattcacttggaaatgattcaaaaattaggatttacaccattgcttccaattttagccatggctggtggtggccaagtaggtgctgccgtcgctttatgggtaagatgtcgtaagaacaagcaacttgttaatatgattaagggtgctttacctgttggtattcttggtgttggtgaaccgttaatttatggtgttaccttgccattaggtcgcccatttattaccgcatgtatcggtggtggtattggtggtgctgtagttgcagcctttggtcaagtaggctcaattgctattggaccatctggcgttgctttaattccattaattgctcataacatgtggtgggcttatgtacttggacttctagctgcatatatcggtggttttattgctacttacttctggggcgtgccaaaagaagctatgcttccagatggtcaagctggtcctgaagttgctgaaagaagagaagctgaagaagaagcaactaacttggatatgaagcctgctactacatcaacaattgctaagccaattacccaagatattgcagccccagtttctggacaaattgaaggtttagaagaagtaaatgacgaagtattttcacaaaaaatgttaggtgatgggttcgcaattattccaactgatggatcaattgtggcttcagtagatggaactatagttagtgtcatgtctactaaacatgctttgactatgacatccgcaaaaggtaaccttgaaatcttaattcatatgggaatcgatacagtagaattaaaaggtgaaccatttgatattaccgtaagagaaggacaaaaagttaaagctggtcaaagccttggaacaatgaatatcaataagattaaagaagcaggtaaagatccagttgtaatgatggctgtaactaataaggatactgttcaggatatgaagctattacaatttggagaagttaaggcgggagagtccgtcctagaagttaccagtaag

SEQ ID NO: 34 - protein, 663 aa, Lactobacillus acidophilus
MEKDKYQRLSDEIYAQIGGIDNVESIIHCMTRLRIKIRDMSKVNITALKKIDGVLGVVEADTLEIVLGPGVNTKVAKIMNDKAGVKEGEIFPANSYQANKSEVERKAAEVHAAHKASLKQTWWRAALQHISAIFVPLIPAFVGAGLISGVAGILRNMLTAKMLPGSWNLGVTVLAMISSALFAYLNIYVGINTAKEFGATPGLGGIIGGIVYLPGIVAPVTIPNIFDGKPLAAGQGGIIGVLLGVWLLSYVEKFFHKHIADSVDIIFTPFLTILIMGLFTVFLIMPLAGWFSNSLVGAINWVLKVGGPVSGFILGLFFLPMVMLGLHQILTPIHLEMIQKLGFTPLLPILAMAGGGQVGAAVALWVRCRKNKQLVNMIKGALPVGILGVGEPLIYGVTLPLGRPFITACIGGGIGGAVVAAFGQVGSIAIGPSGVALIPLIAHNMWWAYVLGLLAAYIGGFIATYFWGVPKEAMLPDGQAGPEVAERREAEEEATNLDMKPATTSTIAKPITQDIAAPVSGQIEGLEEVNDEVFSQKMLGDGFAIIPTDGSIVASVDGTIVSVMSTKHALTMTSAKGNLEILIHMGIDTVELKGEPFDITVREGQKVKAGQSLGTMNINKIKEAGKDPVVMMAVTNKDTVQDMKLLQFGEVKAGESVLEVTSK

SEQ ID NO: 35 - DNA, 1995 bp, Lactobacillus acidophilus
  CDS (1)...(1995)
  misc_feature (0)...(0): ORF 1777; putative fructose-specific enzyme II, PTS system
atgagaattaaggacattctaagccctgaatccatgatcatggaactcaaggctaccaacaaagaagatgccattaaagaaatggcagatcttgaagtggcaaccgatgttgttaatgatgaagatgcatttatcaagtctatctgggctcgtgaaaatgaatcaactaccggtatcggtggcggaattgcaatgccacacgcacgtaacaagtcaattaacaaggctcgtgtattgtttgctaagagtaaggaaggtattgactacgactcacttgatggtcaaccagttcacttattcttcatgattactgcaccagaaggtgctgataatactcaccttcaagctttagctaaactttcaggtttattgattgatcctgaattggttgaaaaacttaaggctactaagactcctgaagaagttattgatctttttgaaaaggctgaagctaagaaggacgaagaagacaagaaagctgctgaagccagaaaagctaaggaagctgctaaggctcaaggctcaagcgatgatgacaacaagccattaatcgttggtgttactgcatgtatcaacgggattgcccacacttacatggctcaagaagccttgattaaagaaggtaagaagcgtggcattgaagttagaattgaaactaacggttctgaaggtgttaaagacaagcttactccagatgaaatcaagcgtgctaagggtgttatcattgcttccgataagaaggttgacatgccacgttttgatggtaagcctttagttaaccacccagttgttgatggtattaacaagccgggtgaattgattgatgatattatggacggtaaggcagatacttaccatgctagtgcagctgacaagtcagaagaatcatcaagtactgaaaagccaggcttatgggcaagtatttataagaacttgatgagtggtattagccacatgcttccattcgttatcggtggtggtatcttaatggctatctccttcatcgtagaaaactacggtggtggtgcaaagactcctgcatttatcttcttgaacaacgcaggtaacttggcctttgccttcatggttccagttctttcagcttacattgctgaatcaatcggcgacttaccagcattaatgccaggttttgttggtggttacatggcttctattgctaatggtcaattccaagttaacgttcaagcccatgcaacttcaccagctggattcttaggtggtattgctgccggtttcattgctggttacttaatgatcggtttaaagaaggcctttgctaaattacctcgttcagttgaaggtatgaagccaatgttgttctatccaatcttaggattgctctttattgcagcaattatgttctacatcattaacccaatctttagtggtgtaaactttgcaattactcacttcttgaacagtatgggtactggtaacttggtacttcttactactatcttggcaggtatgatgtcaatcgatatgggtggtcctttcaacaaggctgcatatgtctttgcttcaggtgcatttgctaacgacccacactcaactactgctgctattttgatggctgccgtaatggttggtggtatggttcctccatttgctactgctattggtactacattcttcaagaacaagtacactatggaagaacgtcgtgcaggtgtttctaactgggtattaggattctcattcattactgaaggtgctattccatttgccgcagctgacccaggtcgtgtaattccttcatgtatcattggttcagctgtaggtggtgccttagttggtttatggcacgttggtgttcctgctcctcacggtggtctttgggtatcaccacttgcaggtaacattggtggacctatgcacattttgttctacttcttagcaactattattggttcaatcgtagcaggtttgatcatgagtttctggaagaagaacgttaaagatgatcctaacgaa

SEQ ID NO: 36 - protein, 665 aa, Lactobacillus acidophilus
MRIKDILSPESMIMELKATNKEDAIKEMADLEVATDVVNDEDAFIKSIWARENESTTGIGGGIAMPHARNKSINKARVLFAKSKEGIDYDSLDGQPVHLFFMITAPEGADNTHLQALAKLSGLLIDPELVEKLKATKTPEEVIDLFEKAEAKKDEEDKKAAEARKAKEAAKAQGSSDDDNKPLIVGVTACINGIAHTYMAQEALIKEGKKRGIEVRIETNGSEGVKDKLTPDEIKRAKGVIIASDKKVDMPRFDGKPLVNHPVVDGINKPGELIDDIMDGKADTYHASAADKSEESSSTEKPGLWASIYKNLMSGISHMLPFVIGGGILMAISFIVENYGGGAKTPAFIFLNNAGNLAFAFMVPVLSAYIAESIGDLPALMPGFVGGYMASIANGQFQVNVQAHATSPAGFLGGIAAGFIAGYLMIGLKKAFAKLPRSVEGMKPMLFYPILGLLFIAAIMFYIINPIFSGVNFAITHFLNSMGTGNLVLLTTILAGMMSIDMGGPFNKAAYVFASGAFANDPHSTTAAILMAAVMVGGMVPPFATAIGTTFFKNKYTMEERRAGVSNWVLGFSFITEGAIPFAAADPGRVIPSCIIGSAVGGALVGLWHVGVPAPHGGLWVSPLAGNIGGPMHILFYFLATIIGSIVAGLIMSFWKKNVKDDPNE

SEQ ID NO: 37 - DNA, 1002 bp, Lactobacillus acidophilus
  CDS (1)...(1002)
  misc_feature (0)...(0): ORF 500; Sucrose operon repressor (SCR operon regulatory)
atgatagttatgaaaggaaataaaaatatggcaacaatgaaagacgttgctcaaagagcaggagttggtgtcggtacagtctctagagtaattaaccatgtaccaggggttaagaaaagtactttagtgaaagttaaagaggcaattaaggaattaaattatattcctgatgagtatgccaggggattaaaaacaaaatcttctagaacaattgcacttattttgccatctatctggcatccattcttttctgaatttgcatattatgtagaaaagagattatacaaggaagattacaagctcttattatgtaattcaaacagagatccaaaagaagaagctaaatatataaagatgcttaagcaaaataaaattgatgcgattatcgctattacatatagtgatattggtcaatatatttattccaacattccttttgttagcttagatcgttattttgagaaaaaagtatcgtatgttacgtcagacaactacgaaggtggaaaattagcggcaaaggagttattagctcatggtgctaaaaatattgcatatataggcagccatagtaaatatcctaatgctactatgctacgaaaagatggttttgatgattatcttaaagaacatgacataaactacaaggaaatattcttacatgaaccagtgcctgaggctgattttattaatcatcttttagaaatgttaactgcacatcctgaaattgatgggattttttgtcatacggattctttgttattaacgttaagaaaagctttaatccaacatggttatcgtgtgcctgaagatatacaattaattggctttgatggtattaaaatggattcggctcattctttaggtatatctacaattgcacaacctgttgaaaaattggcaaatggagcggtggatttagttttaaagaagatagcagatcctagtgtaaaaaatgaagctaaaatgtatccagtaaaatatataaatggcaataccacaaaa

SEQ ID NO: 38 - protein, 334 aa, Lactobacillus acidophilus
MIVMKGNKNMATMKDVAQRAGVGVGTVSRVINHVPGVKKSTLVKVKEAIKELNYIPDEYARGLKTKSSRTIALILPSIWHPFFSEFAYYVEKRLYKEDYKLLLCNSNRDPKEEAKYIKMLKQNKIDAIIAITYSDIGQYIYSNIPFVSLDRYFEKKVSYVTSDNYEGGKLAAKELLAHGAKNIAYIGSHSKYPNATMLRKDGFDDYLKEHDINYKEIFLHEPVPEADFINHLLEMLTAHPEIDGIFCHTDSLLLTLRKALIQHGYRVPEDIQLIGFDGIKMDSAHSLGISTIAQPVEKLANGAVDLVLKKIADPSVKNEAKMYPVKYINGNTTK

SEQ ID NO: 39 - DNA, 1245 bp, Lactobacillus acidophilus
  CDS (1)...(1245)
  misc_feature (0)...(0): ORF 502; ABC transporter sugar binding protein
ttgtcactaactggctgtagtaataatagtcaaagtggcagtagtaacaacaaaaacgttactatgtgggttcacttttctaatactgatccggaaggtaaagcattacaaaagaatatcaatgactttaataaagagaataagcatggctataaagcaaaagttcaatatattcctcgttctggttcaggtggcggctatgaagataagatcaatgctgctttaaactcaggaagtttaccagatgttttaactttggatgctcctaacacagcagcttatgcacattcaaaaattattcaaccaatcgataagtacattactaataaagacgatattctaccaactattattaagcaaggtacttataaaggtaagttatatgctgctggctattcagaatcaagcatcggcttctattacaacaagaagatgttcaaagaggctgggattaaagattcagaaattgctactttacagcatccatggacttggactcaatttaaagatatttgtaagagacttaaaaaccacttccatgaaccagcaattaatatgaacttgaatgaccactcagaaatggctctttattcattagcaccatttgtatggtcagctggtggtagcattactaatcctgctggcacaaaggcagttggctactttaattccaagcaaactacttcagccttccaattaattcaagacatggtcaaagatggttacactactatttcaccaaaggataaaggttttgaaactggcaaatatgccatgatgatgactggtacttgggaagttcaaactttgcaaaaccaatacaagaatttgcaatggggcgtaatgccatatcctgtatctccagctactcacaaagaggtttcaccaacaggctcatggcaatacgcaatgtcttctgcagctaagaacaagaaggcagctggtgctttgattaacttcttaatgagtaagaagtgtatgtaccgcagcgatatggctaacactgttttgccagcacgtaagagtgtatctaagatgatgatgcctaaagttaatgaacaaatgagattcttcattaagcaaaaccaaactacgggtcatgctcgtccagttttagttaactacccacaagtaactagaacatttgctgatactgttcaaaatgtaactttgtacaagaagaatcctaatgtacaaaaggtaatgaacgaacaagctaaagttattcaaaagtaccttgagaaa

SEQ ID NO: 40 - protein, 415 aa, Lactobacillus acidophilus
MSLTGCSNNSQSGSSNNKNVTMWVHFSNTDPEGKALQKNINDFNKENKHGYKAKVQYIPRSGSGGGYEDKINAALNSGSLPDVLTLDAPNTAAYAHSKIIQPIDKYITNKDDILPTIIKQGTYKGKLYAAGYSESSIGFYYNKKMFKEAGIKDSEIATLQHPWTWTQFKDICKRLKNHFHEPAINMNLNDHSEMALYSLAPFVWSAGGSITNPAGTKAVGYFNSKQTTSAFQLIQDMVKDGYTTISPKDKGFETGKYAMMMTGTWEVQTLQNQYKNLQWGVMPYPVSPATHKEVSPTGSWQYAMSSAAKNKKAAGALINFLMSKKCMYRSDMANTVLPARKSVSKMMMPKVNEQMRFFIKQNQTTGHARPVLVNYPQVTRTFADTVQNVTLYKKNPNVQKVMNEQAKVIQKYLEK

SEQ ID NO: 41 - DNA, 882 bp, Lactobacillus acidophilus
  CDS (1)...(882)
  misc_feature (0)...(0): ORF 503; lactose transport system permease protein; LacF
atgcaagttaaaggtataaagagacaaattgggtggctgtatgtttttccagctattctaattttactaacatttttaatcatcccatttttgatgtcatttagttattcttttacgaactataatattttgacaccatgggctaagcaatatgtaggttttacaaattacattaatacttttaaagatcctgtctttttacaaagtttaaaaaatattgcacaattcgttatctttattatgccgattcaggttggtgcggctttaggtttagctttaattgttaataaaaagcgtcctggaaatacattctttaagatttcattctttgcaccacaagttgtatctttgactgttgtctcaattctttggatgtatattcttaatcctgaccaaggcttgttaaatggtattttgggtatttttcacattaaaccacagccatttttaacttcacctaagcaagcgatgtttgctattatcggtgtatctgcttggcagggtgctggttatcagatgttaatctttttagcaggattacaaaatattcctgattcattgtatgaagcagctgaattggatggagcaaatagttggcaaagatttttacatattactttgccaatgcttaaacctacttcaattatgatcttaacgacgactttcattagtgctttcaacttgatgattcaaccaatgatcatgacccaaggtggcccacaaaatgctactatgacgccaatatactacatttatcgtacaggttttactgatcgtcaattaggatatgcaagtgcaatgagtgtaatctacggcattatcattatcatctttaccattattcaaagaaagatcacaaacgctggaggcgacgagaatgca

SEQ ID NO: 42 - protein, 294 aa, Lactobacillus acidophilus
MQVKGIKRQIGWLYVFPAILILLTFLIIPFLMSFSYSFTNYNILTPWAKQYVGFTNYINTFKDPVFLQSLKNIAQFVIFIMPIQVGAALGLALIVNKKRPGNTFFKISFFAPQVVSLTVVSILWMYILNPDQGLLNGILGIFHIKPQPFLTSPKQAMFAIIGVSAWQGAGYQMLIFLAGLQNIPDSLYEAAELDGANSWQRFLHITLPMLKPTSIMILTTTFISAFNLMIQPMIMTQGGPQNATMTPIYYIYRTGFTDRQLGYASAMSVIYGIIIIIFTIIQRKITNAGGDENA

SEQ ID NO: 43 - DNA, 855 bp, Lactobacillus acidophilus
  CDS (1)...(855)
  misc_feature (0)...(0): ORF 504; lactose transport system permease protein; LacG
atgcataagtttatgacacatagaagattccatacgatatggacaacagtgttaattactatattagccttattcttcttgttcccattagtttggatgattgtttcttcgatgaagccagaatcccaaatttatgctaacatcagtaatttaaaagctttcctaccatcaaaaaatatcggtgattggggaagcgcatatgcaagtatttttcatagattccctgtaatgagatacatttttaacagtgtattttatgcagcaagtgtaactattggatctattgtagtaaatgctttagctggatatggttttgcaaaatttaattttacaggacgtaaattattatttggtttattaattgcattattagttattcctggtactacgcttttaattcagcaattccaaattgctaaaagtattggtatcttgaacacttcattagcagttattttgcctggtatttcaagtcctttctatatttacatgtttagaaacgcttttgccgcgattccagatagtattacagaggcggcagaactagatggtgcaagtaattttaggaccttttggaatattttgttaccgatgactttaccaactgtagccactgttggaacactatcattcattggcagttggaatgactatgtatggccattaatggttttgactaattctgatcaattcccacttcaagtagctgttactaatattaacagcacaaacccagtctacatgaaccaagttatggctattttgaccatctctacagtacctttgattttggtttacatcttcttccaaaagtatcttactcaaggaatgggatctgcaggtaacggtgataaa

SEQ ID NO: 44 - protein, 285 aa, Lactobacillus acidophilus
MHKFMTHRRFHTIWTTVLITILALFFLFPLVWMIVSSMKPESQIYANISNLKAFLPSKNIGDWGSAYASIFHRFPVMRYIFNSVFYAASVTIGSIVVNALAGYGFAKFNFTGRKLLFGLLIALLVIPGTTLLIQQFQIAKSIGILNTSLAVILPGISSPFYIYMFRNAFAAIPDSITEAAELDGASNFRTFWNILLPMTLPTVATVGTLSFIGSWNDYVWPLMVLTNSDQFPLQVAVTNINSTNPVYMNQVMAILTISTVPLILVYIFFQKYLTQGMGSAGNGDK

SEQ ID NO: 45 - DNA, 1290 bp, Lactobacillus acidophilus
  CDS (1)...(1290)
  misc_feature (0)...(0): ORF 505; Sucrose-6-phosphate hydrolase
atgaaggcaaatacttacttatataaaaaaataagaaaaattgatcatgatgttttaagaccaacttttcacttcaatgctccagttggttggatcaatgatcctaatggattgatttattataaaaattattatcaattgtattatcaatacaatccatatgctccacactgggatagcatgcattggggtcacgctcgaagcaaagacggaatccattggcaagatatgccagtagcaatgaaaccggatcatgaatatgataaatcaggcgtattctcaggatctgccattgaaaaaggtggcaaattatatgtcatctatacgggacatgttgatgaaaatggtaaggcagttgaaacccaatgtgtagctgtttctgatgatggtgtagattttaaaaagtataaaaacaacccagtaatgacgatagccgatttacctggtgaagtagatgaaagtaactttcgtgatcctaaagtttttgaacatgatggtaaatactattgtgtaatagcagcagctattaatggtcacggcagtctgatcttgtttgaatcagaagatttacttcattggtcatttaaatctattttgctacaaggtgaaaaatatggattaatgacggaatgtccagattatttcaatatcgatggaaaagattatcttgcctttagtgtgattttaggtgatgacaaacatagtattgtttatatcgctgaaggacacatggattggcaaactttcaaatttgagttggaaaaatgtgatcgtttagacgatggagatgatttctacgcttctcaaagttttatgaatgaaaaaggcgaaagaattgtcattccatggttaagaagtgctgatcatgttaattatctagaagaatctggtcatctttggaatggaatgatgggaattccaagaaaattaactattgataataatgagttgattcaaagtccattaggtaaatttaaacaaatttcattgtcagatagtgagattactttaggaattaatcaattagccgaagatattccggttagctatagcttaatcttaaaaggcgacaatggagaaatttatattactcgtacaaatgagtcacagtacactatagacattcattcaccagcatttactgaagaacttgtatggcattcaaataagcataaattgacgttagtaattgataattctagtttagaaatttttagtcaaactaaaacgttaagtgtcgttacctttatcgctggaattaatcgaatggaacttaaaaaagtggatttg

SEQ ID NO: 46 - protein, 430 aa, Lactobacillus acidophilus
MKANTYLYKKIRKIDHDVLRPTFHFNAPVGWINDPNGLIYYKNYYQLYYQYNPYAPHWDSMHWGHARSKDGIHWQDMPVAMKPDHEYDKSGVFSGSAIEKGGKLYVIYTGHVDENGKAVETQCVAVSDDGVDFKKYKNNPVMTIADLPGEVDESNFRDPKVFEHDGKYYCVIAAAINGHGSLILFESEDLLHWSFKSILLQGEKYGLMTECPDYFNIDGKDYLAFSVILGDDKHSIVYIAEGHMDWQTFKFELEKCDRLDDGDDFYASQSFMNEKGERIVIPWLRSADHVNYLEESGHLWNGMMGIPRKLTIDNNELIQSPLGKFKQISLSDSEITLGINQLAEDIPVSYSLILKGDNGEIYITRTNESQYTIDIHSPAFTEELVWHSNKHKLTLVIDNSSLEIFSQTKTLSVVTFIAGINRMELKKVDL

SEQ ID NO: 47 - DNA, 1104 bp, Lactobacillus acidophilus
  CDS (1)...(1104)
  misc_feature (0)...(0): ORF 506; Multiple sugar-binding transport ATP-binding protein msmK
atgacagaagtagatttgaaccatgtatacaaaaagtatgatggaaatgataaatattcagtaaatgactttgatttacacatcaaagacaaggaatttatagtttttgttggtccatcaggttgtggtaaatcaacgaccttaagaatgattgcaggtttggaagatatcacagaaggtacgcttgaaatcgaccacatggttatgaatgatgtggctccgaagaatagagatatagcaatggtcttccagaactatgccttgtatccacatatgactatttatgacaatatggcatttggattgaagctaagacattatcctaaagaaaaaattgatacaaaagtaaagcatgcggctgagattcttggtttaactgattatttaaagaaaaagcctgccgctctttcaggtggtcaacgtcagcgtgttgcattaggtcgttcaattgttagggatgcacctatcttcctaatggatgagcctttgtcaaacttggatgctaaattgcgtgtatccatgcgtgcggaaattgctaaacttcatcaaagattaggtactactacaatttatgttactcacgatcaaactgaagctatgactttggcagatagagttgtagttatgtcagtaggtaaggtacaacaaattggtacacctttggaagtttataacaagcctaaaaacatatttgtagctggttttattggttcaccacaaatgaacttctttaatgttcattataagaatggccgtatttctgatggaaaaggcttgaatatggcaattcctaaaggtaaagccgatatgttggataagaaaggctatgacgataaggatattgtatttggtatcagaccagaagatattcacgccgaagaagcattcttagaaacttggccggatgcagtaattacctctactgttgtggtttcagaattacttggtgcaactattcaactttatcaaaaagttgatggtactgaattcgtcgcagatgtaaattcacgtgattatcacaagccaggtgatcaggtgaaaatgggctttgatattaataaggctcacttcttcgataaagatacgacaatggcaatctacaat

SEQ ID NO: 48 - protein, 368 aa, Lactobacillus acidophilus
MTEVDLNHVYKKYDGNDKYSVNDFDLHIKDKEFIVFVGPSGCGKSTTLRMIAGLEDITEGTLEIDHMVMNDVAPKNRDIAMVFQNYALYPHMTIYDNMAFGLKLRHYPKEKIDTKVKHAAEILGLTDYLKKKPAALSGGQRQRVALGRSIVRDAPIFLMDEPLSNLDAKLRVSMRAEIAKLHQRLGTTTIYVTHDQTEAMTLADRVVVMSVGKVQQIGTPLEVYNKPKNIFVAGFIGSPQMNFFNVHYKNGRISDGKGLNMAIPKGKADMLDKKGYDDKDIVFGIRPEDIHAEEAFLETWPDAVITSTVVVSELLGATIQLYQKVDGTEFVADVNSRDYHKPGDQVKMGFDINKAHFFDKDTTMAIYN

SEQ ID NO: 49 - DNA, 1470 bp, Lactobacillus acidophilus
  CDS (1)...(1470)
  misc_feature (0)...(0): ORF 507; gtfA protein; GLUCOSYLTRANSFERASE
ttgaaccttttttataaggaaggtttaaaaatgaaattacaaaataaggcaatattgataacttatccagatagtttaggtcataatttgaaggacttggatcatgtaatggatcgctattttaataaaacgataggtggtattcatttattaccatttttcccttcaaacggtgatcgcggtttttctcctacaagatatgatgtagttgagcctaagtttggttcatgggaagatgtagaaaagttaagtcaaaagtattatttgatgtttgactttatgattaatcatctttctaaaaaatcctcatattttgaagattttgaagccaagcacgataaaagcaaatatagcgatcttttcttaagttgggataaattttggccaaagggcagaccaactaaagaagatatagatttaatttataaacgaaaagataaggccccatatcaaaatattaaatttgaagatggtactcatgaaaagatgtggaatactttcggcccagatcaaatggatttggatgttagaaccaagacaacacaagattttataaagcataatttacaaaatctttctaaacatggtgctagtttgattcgtttagatgcatttgcttatgcaattaaaaagttagatacaaatgacttctttgtagaaccggaaatttggaatttactcgaaaaggtaaatgattatcttaaagatactccaactactattctgcctgaaattcatgagcattatacgatgccatttaaggtggcagaacatggatactttatttatgattttgctttaccaatggtattgttgtattcactttatagcggtaatagtactcaacttgctgcttggctaaagaaatgtccgatgaagcaatttactactttagatacccacgatggattaggcgtagttgacgcaaaggatattcttacggacgatcaaattagctacacaacaaacgaactttataaaattggtgctaacgtcaagaagaaatattctagtgctgaatatcataatttggatatttatcaaattaatactacttattattctgcattgggtaatgatgataaaaaatattttattgcacggttattacaaatctttgcccctggtattccacaaatttattatgttggattgttagcaggagaaaatgatattcaattattagagaagacaaaagaaggacgcgatattaatcgccactattatgatttggatgagattgcggaacaagttcaaagacctgtagtaaaatctttgattaagttattggaatttcgtaattctgtacctgcatttgatttggaaggttcaatcaaagttgaaactccaagtgaacatgaaattattgtcactagatcaaataaggcaggaacagaagtagctagtacgtacgtagactttaagaacttagactatcaagttaaatacaatgatcaggtctttaatttt

SEQ ID NO: 50 - protein, 490 aa, Lactobacillus acidophilus
MNLFYKEGLKMKLQNKAILITYPDSLGHNLKDLDHVMDRYFNKTIGGIHLLPFFPSNGDRGFSPTRYDVVEPKFGSWEDVEKLSQKYYLMFDFMINHLSKKSSYFEDFEAKHDKSKYSDLFLSWDKFWPKGRPTKEDIDLIYKRKDKAPYQNIKFEDGTHEKMWNTFGPDQMDLDVRTKTTQDFIKHNLQNLSKHGASLIRLDAFAYAIKKLDTNDFFVEPEIWNLLEKVNDYLKDTPTTILPEIHEHYTMPFKVAEHGYFIYDFALPMVLLYSLYSGNSTQLAAWLKKCPMKQFTTLDTHDGLGVVDAKDILTDDQISYTTNELYKIGANVKKKYSSAEYHNLDIYQINTTYYSALGNDDKKYFIARLLQIFAPGIPQIYYVGLLAGENDIQLLEKTKEGRDINRHYYDLDEIAEQVQRPVVKSLIKLLEFRNSVPAFDLEGSIKVETPSEHEIIVTRSNKAGTEVASTYVDFKNLDYQVKYNDQVFNF

SEQ ID NO: 51 - DNA, 984 bp, Lactobacillus acidophilus
  CDS (1)...(984)
  misc_feature (0)...(0): ORF 1481; ribose ABC transporter (ribose-binding protein)
atgaattttaaacgttttttgaaaattactacagttgcgtcgattttagttttagcaggtggaattctaggaggttgtggttctacaggtttaagtaatggatcaggatcgtctgataaagtgacgaagaaagcaccaaaaaatttaaaaattggtgtatctgtttcaacattaaccaatcctgcattcgttaatttgaaaaatgtaattagtaattatgccaagaaacatggctcaaaagttattgtcgatgatgcaaataatgatacatcaaagcaaaataatgatgtagaagatttgataacacaaagagtggatgcattaattattaatccatgtgattcatccgcaatttctgcagttgttaaaaaagctaacgaagcgaatattcctgtagtatgtgtagaccgtagtgcggactcaggtaaagtgatctcaacggttgcttcagataatgttgctggtggtaaaatggcagcaaattggttagttaagacattaggagagaatgctaaagtagcggaaattcaaggtattccaggagcatctgctacacgagaacgtggtaaaggttttgatagtattggcgataagaaattagatattgtaacaaagcagacagctcaatttgatcgtgcaaaagctttaacagtaactgaaaatattttgcaagcacatagaaacattaaaggtatttttgctcaaaatgatgaagaagcagttggtgctgctcgtgctgtgaaagctgctaataagaaaataactattattggttttgatggggcgcttgcttgtttgaatttgattcaaaagggtcaaattactgctactgtaggtcaacaatggaataagataggtcaacagtcagttcaaatggtttatgattactatcaaaataaaaaagttccaaaaaatgataaagttccagtaaaaattattacgaaaaagaatgttagcgaatttaagaagcaggtttatgataag

SEQ ID NO: 52 - protein, 328 aa, Lactobacillus acidophilus
MNFKRFLKITTVASILVLAGGILGGCGSTGLSNGSGSSDKVTKKAPKNLKIGVSVSTLTNPAFVNLKNVISNYAKKHGSKVIVDDANNDTSKQNNDVEDLITQRVDALIINPCDSSAISAVVKKANEANIPVVCVDRSADSGKVISTVASDNVAGGKMAANWLVKTLGENAKVAEIQGIPGASATRERGKGFDSIGDKKLDIVTKQTAQFDRAKALTVTENILQAHRNIKGIFAQNDEEAVGAARAVKAANKKITIIGFDGALACLNLIQKGQITATVGQQWNKIGQQSVQMVYDYYQNKKVPKNDKVPVKIITKKNVSEFKKQVYDK

SEQ ID NO: 53 - DNA, 855 bp, Lactobacillus acidophilus
  CDS (1)...(855)
  misc_feature (0)...(0): ORF 1482; Ribose transport system permease protein rbsC
ttgccccccaataatttattaaacttattacgtcaagcttcggttaatgctttaattgcgtttggtatgacgtttgtaattttaacggctggtatcgatttatctgtaggctcaattctagcttttactggtgcaattatagccatgatgattttaaatggtactcctgcatggttagctggttttataggtttaatgcttggtgctgttctaggtgccataaacggtttgtttattacttggggtagagtaacgccatttattgctacattagctacgatgactatttggagaggcgctacttatgtatttacaggtggtaacccagttactgggggaaaaatgaatacaagtttcttctttcaatttattgggcaaggttacttatttggaattccgtttccagtcattattacgttaatcgcttttataatttgttatattttacttcataaaactgcatttggtcgtaaaatatttgctcttggtggtaatgagaaagctgcttttgttgcgggtgtaaaaactaaaaaacttttaattataatttatactatttcaggattattagcagctcttgccggttttattttaacttcaagattaggatcagcacaaccagatgcgggtatgtcatatgaaatggatgccattgcctcaacagttattggtggtgctagtctaatgggtggtaaaggtagaatgtcaggcacattagttggtgctttacttattgcttctttaagtaatggtatgaatttattaggtattaatagtttttaccagcaaattgttaaaggtgttgtaattttaattgctgttatgatagattctcaaactcaaagaaatcgtgaa

SEQ ID NO: 54 - protein, 285 aa, Lactobacillus acidophilus
MPPNNLLNLLRQASVNALIAFGMTFVILTAGIDLSVGSILAFTGAIIAMMILNGTPAWLAGFIGLMLGAVLGAINGLFITWGRVTPFIATLATMTIWRGATYVFTGGNPVTGGKMNTSFFFQFIGQGYLFGIPFPVIITLIAFIICYILLHKTAFGRKIFALGGNEKAAFVAGVKTKKLLIIIYTISGLLAALAGFILTSRLGSAQPDAGMSYEMDAIASTVIGGASLMGGKGRMSGTLVGALLIASLSNGMNLLGINSFYQQIVKGVVILIAVMIDSQTQRNRE

SEQ ID NO: 55 - DNA, 1488 bp, Lactobacillus acidophilus
  CDS (1)...(1488)
  misc_feature (0)...(0): ORF 1483; ribose ABC transporter ATP binding protein
gtgaatctactaatgaaaattgaattgaatgatattaaaaaaaattttggtactaataaagtattaagaggtgtggattttaaagttaattcaggagaagttcatgctttaatgggagaaaatggtgctggaaaatcaactttaatgaatattttaacaggtctattaaaaaaagatgctggttcaattaaagttgacggacaagaaacaacatatgcgaatgcactggacgctgaacatcatggtatcagttttattcatcaagaaatgaataatttcccagaaatgagcgttgtagataacatttttttaaataaagaaattaaaaataaattcggcttgatgaatcaaaaattaatgaagaagaaggcaaaagcatatttagataaattaggttcggatatagatgtagatatgaagattggcaacttgacagtgggacaacaacaaatgatcgagattgctaaatctttaatgacaaatgcaaaaataataattatggatgaaccaacagcagcattgactgaaaatgaaacagatattttgtttaaaactattcgtgaattaaaaaaacaaaatgtaggatttatatatatttcacatagaatggaagaattatgggaaatatgtgatcgagtaacagttatgcgagatggtatatctatcaatacgtataatacaaaagacgtaaaagaagataaaattgttcatgatatggttggtagagatataggtgattactatccagaaagaaaaccaaaattaggccctgtagccttaaaagctgaaaatttgtcaggggaaaaattccataatatctcttttgaagttcatgagggtgaaattcttggattttctggcttgatgggcgctggtcgtacagaaacaatgagagctttgtttggaatagataaacttactagcggaaaaatttatcttgaaggaaaagaggtaaagctaaatagtcctagtgattctattaaacatggtattggttttttaactgaagatagaaaaaatgagggattagtattagatcaatctttagaagataatattgctttaccaagtattgatggttttagaaaacatggaattattgatcaaaaagcagaagataaatttgctgagatgctgatgaaacgtttaactgtaaaagcacaaagtgcagatgtttctgcaagaagtttatcaggaggtaatcaacaaaaagttgttttagctaaatgggtaggaagcggatcaaaagttttaattttggatgaaccaactcgaggtgtagatgttggtgctaaaaaagaaatttatgaattgatgaatcaattaactgacagacatgtagcaattattatggtttcaagtgatttgcctgaagtgttaagtatgagtgacaggattgaagttctatatgaaggaaaacagatgggagttgttgatgcaaaaggtgccactcaggagcaagtaatgaaactagctacgggaggaaag

SEQ ID NO: 56 - protein, 496 aa, Lactobacillus acidophilus
MNLLMKIELNDIKKNFGTNKVLRGVDFKVNSGEVHALMGENGAGKSTLMNILTGLLKKDAGSIKVDGQETTYANALDAEHHGISFIHQEMNNFPEMSVVDNIFLNKEIKNKFGLMNQKLMKKKAKAYLDKLGSDIDVDMKIGNLTVGQQQMIEIAKSLMTNAKIIIMDEPTAALTENETDILFKTIRELKKQNVGFIYISHRMEELWEICDRVTVMRDGISINTYNTKDVKEDKIVHDMVGRDIGDYYPERKPKLGPVALKAENLSGEKFHNISFEVHEGEILGFSGLMGAGRTETMRALFGIDKLTSGKIYLEGKEVKLNSPSDSIKHGIGFLTEDRKNEGLVLDQSLEDNIALPSIDGFRKHGIIDQKAEDKFAEMLMKRLTVKAQSADVSARSLSGGNQQKVVLAKWVGSGSKVLILDEPTRGVDVGAKKEIYELMNQLTDRHVAIIMVSSDLPEVLSMSDRIEVLYEGKQMGVVDAKGATQEQVMKLATGGK

SEQ ID NO: 57 - DNA, 402 bp, Lactobacillus acidophilus
  CDS (1)...(402)
  misc_feature (0)...(0): ORF 1484; ribose permease RbsD
gtgactaaaatgaaaaaaactggaattttaaattcagatatttctagagttgttgctgatatggggcatatggattggttaggaattggtgatgctggcacaccggttccaaaaactacagaaaaaattgatttggctgttagtgcaggaatgccatcttttataagtgttttgaaagaagttttaaaagagttacaagttcaaaagatttatgttgcagatgagataaaggatagcaatcctaaacaattagaaaatataaagagaattttaccggatgttgaaattaaatttattcctcatactcaattaaagaaaaatttaagcgaagcaaaagcttttattagaactggagaagaaactcccttttctaacgtaattcttgagagtggcgttatattt

SEQ ID NO: 58 - protein, 134 aa, Lactobacillus acidophilus
MTKMKKTGILNSDISRVVADMGHMDWLGIGDAGTPVPKTTEKIDLAVSAGMPSFISVLKEVLKELQVQKIYVADEIKDSNPKQLENIKRILPDVEIKFIPHTQLKKNLSEAKAFIRTGEETPFSNVILESGVIF

SEQ ID NO: 59 - DNA, 924 bp, Lactobacillus acidophilus
  CDS (1)...(924)
  misc_feature (0)...(0): ORF 1485; ribokinase RbsK
atgagttcaaagatatctattttgggaagtattaatttggatagcacttatcatgtagataaaattccattaccaggtgaaacgattcatgttaataaaaagacatttgctgcaggtggcaaaggagctaatcaagcagtggcggcaaagcgtagtggtgcaacggtaagctttattggtgctgtaggtaatgatgctgccggtaaatatatgttgaatgaattagagaaagaaaaaattaatttgtcaaatgtgcagataaaagatacagcccaaacggggacagctaccgtcttattagatgaaaacgggcaaaatagtattttagtttacgcaggtgctaatgggctaattgatagtagccagattaataaagcagaagatacaattgcaaattccgattatattattgctcaatttgaaactccaatttcagcaataatatcagcttttacaattgcaaaaaaacatggcgttacaacaattctaaatccggctcctgctactacaatagataataaattgctgaaagttacaaatattattgtacctaatgaaacagaaagtgcagctattactggaataaatgtaaccgatgaagaatcaatgcaacgaactgcaagatatttcagagaaaaaggagtaaaagtaactattatcactttaggctcaaggggagtttactattcaagtcctactgaaaatcggtttatttcagcatataaagttaatgcagtagatacaactggagctggtgatacatttattggcgccatgacttctgtattaactactgatttgttaaatatttctgcagcaattgattatggtcaacaagcttcatcaattacagtacaaggaataggagctcaaccgtctattccaacaaaagaaaaaataaaacaggtatacagaatgagtgac

SEQ ID NO: 60 - protein, 308 aa, Lactobacillus acidophilus
MSSKISILGSINLDSTYHVDKIPLPGETIHVNKKTFAAGGKGANQAVAAKRSGATVSFIGAVGNDAAGKYMLNELEKEKINLSNVQIKDTAQTGTATVLLDENGQNSILVYAGANGLIDSSQINKAEDTIANSDYIIAQFETPISAIISAFTIAKKHGVTTILNPAPATTIDNKLLKVTNIIVPNETESAAITGINVTDEESMQRTARYFREKGVKVTIITLGSRGVYYSSPTENRFISAYKVNAVDTTGAGDTFIGAMTSVLTTDLLNISAAIDYGQQASSITVQGIGAQPSIPTKEKIKQVYRMSD

SEQ ID NO: 61 - DNA, 855 bp, Lactobacillus acidophilus
  CDS (1)...(855)
  misc_feature (0)...(0): ORF 1864; maltose ABC transporter permease protein
atgaagtcatattctaatcaaagacggctctcattaatctttcggtatattcttttaactgtattagctattctttggattttaccgattgtctggatcgtcttggcaagtttttcatacaatgatactggatttgtttcgaccttctggccagaacaatttactttgcaaaactatattggtatttttactaattcacagtatccatttgttaactggattattaatacattgattgtttcacttctttcaatgattatctcaacattcttaacaatttcagttgcctatgttttatcacgacttcgttttaagtttagaaagccatttcttcaaattgctttagttttggggatgttcccaggtttcatgtcaatgattgccttgtactacatcttaaaaggtttgaatatgttaaacctctttggtttacttttggtttacgttggtggtgccggacttggcttctacgttgctaaaggattctttgatacaattcctagatcaattgatgaagctgctgaaattgatggtgctactaagtggcaagtatttcttcatattggattgccactttcaaagccaatgatcgtttatactgctttaactgctttcattgcaccttggacagacttcattttctcaggtatcattctttcaacttcaggaaatgcgaagacttatactattgcctacggactttacaacatggttcacacggctaagggtaatgcaactgcatactttgcacaattcgttgcaggatgtgtaatcattgctatccctattactatcttgtttgtcttcatgcagaagttctatgttaatggtattactgctggtgctgataaaggt

SEQ ID NO: 62 - protein, 285 aa, Lactobacillus acidophilus
MKSYSNQRRLSLIFRYILLTVLAILWILPIVWIVLASFSYNDTGFVSTFWPEQFTLQNYIGIFTNSQYPFVNWIINTLIVSLLSMIISTFLTISVAYVLSRLRFKFRKPFLQIALVLGMFPGFMSMIALYYILKGLNMLNLFGLLLVYVGGAGLGFYVAKGFFDTIPRSIDEAAEIDGATKWQVFLHIGLPLSKPMIVYTALTAFIAPWTDFIFSGIILSTSGNAKTYTIAYGLYNMVHTAKGNATAYFAQFVAGCVIIAIPITILFVFMQKFYVNGITAGADKG

SEQ ID NO: 63 - DNA, 1356 bp, Lactobacillus acidophilus
  CDS (1)...(1356)
  misc_feature (0)...(0): ORF 1865; maltose ABC transporter permease protein
atgtttctaaagaaaaagcatgtagctcctaaagcgacataccgtgaagtatggtcaaaaggtgatcttgctaccaagttatcatttttcataatgggtagtaatgccttagctaacaaacaatgggtaaaaggtcttgcatttttactttcagaaattattttcattgtttggtttgttcttagcggtattccaactttaaatactttagctacattaggtactaataagaccaaaaaagttgtttatgatgctgcacaaggtgtttatgttactaagcaaccgtcaaactcagttttaattttgctatttggggtgctggcagtaattttatgtatagcaattatttatctatacattgttaacttgcgctcaacaagacataattacatattaaaacgtgatggtggtcacattccgaccaatgttgaagaacttaagagcttacttgacacgcgtttacacgcaactttaatggttataccattattaggtattttgttctttaccatcttgccaacaatctttatgatttcaatggcatttactaactatgaccgtcaacacccaattgccttctcttggactggatttcaagcatttggtaatgttcttagtggtgacttagcgggtactttcttcccagtattgggctggacattgatttgggctgtagcagctactgctactactttcttctttggtgtgttacttgctttattgattgaatccaagggtattaaacataagggcttttggagaacagtctttgtaattgtttgggctgttcctcaattcgtttcacttttaatgatggctcagttcttggactatcaaggtgctttaaacaatatcttgatgaacttacactggattagctctcctatccactttattgataaccaggcttcaccattggtagccagaattacagttattattgttaacatgtggatcggtattccagtttcaatgctggtatctacagctattattcaaaacttgccacaagatcaaattgaagctgccaagattgatggtgctaatgctgcacaaattttcagatcaattactttcccacaaatcttatttgttatggcaccttcacttatccaacaatttattggtaacattaacaacttcaatgttatcttcttgctgacaggtggtgcgccgatgaacagtcactataacggcgccggatcgactgacttactggtaacgtggttgtataacttaacgttcgggcaagagcagcgatataacgcttcagccgtacttggtatcttaatctttataattagtgcggttgtatcgttgatagcatatagacacactaacgcttataaggagggc

SEQ ID NO: 64 - protein, 452 aa, Lactobacillus acidophilus
MFLKKKHVAPKATYREVWSKGDLATKLSFFIMGSNALANKQWVKGLAFLLSEIIFIVWFVLSGIPTLNTLATLGTNKTKKVVYDAAQGVYVTKQPSNSVLILLFGVLAVILCIAIIYLYIVNLRSTRHNYILKRDGGHIPTNVEELKSLLDTRLHATLMVIPLLGILFFTILPTIFMISMAFTNYDRQHPIAFSWTGFQAFGNVLSGDLAGTFFPVLGWTLIWAVAATATTFFFGVLLALLIESKGIKHKGFWRTVFVIVWAVPQFVSLLMMAQFLDYQGALNNILMNLHWISSPIHFIDNQASPLVARITVIIVNMWIGIPVSMLVSTAIIQNLPQDQIEAAKIDGANAAQIFRSITFPQILFVMAPSLIQQFIGNINNFNVIFLLTGGAPMNSHYNGAGSTDLLVTWLYNLTFGQEQRYNASAVLGILIFIISAVVSLIAYRHTNAYKEG

SEQ ID NO: 65 - DNA, 1224 bp, Lactobacillus acidophilus
  CDS (1)...(1224)
  misc_feature (0)...(0): ORF 1866; maltose ABC transporter substrate binding protein
atgaagttttggaagaaaatggctttaggtagtactgctgttttagctgctatgtcacttgcagcttgttcaaatggctcatcaaattcatcaagttcaagtaacacttcaaataagaaggctaacttgacactttgggtagatactgaacaagtaccttactacaaacaaattgctaaggactttactaagaagaacaagaacattaaggttcgtgttgtacaaagtccaaacggttcagctaacgctaagacagatgttggtaaggacccatcaaaggcagctgatgtatttgaagtacctaacgaccaattaggtcaaatggcagaagcaggctacattaacccactttcaccatctgcatctaaggacatcaaggctaactacattgatgttgcatcaaagggtgtaacttggaagggcaaggtttacgcattttcatacgcacaacaagctcaaactatttactacaacaagtctaagctttcagcaaatgacgttaaggattggaagactttaacttctaaaggtgttgtagctactgacttcactaacgcatatgtaatgtggccagtaatgttctcagcaggtacgaagctttatggtaacaatggtgaagaccttaagggttcaacatttaattcacaagacggtattaatgctttgaagtggtacgcagctcaaaagaagaataaaggcgtaatgcaaacttcaaatgctttgaatcaattgaagaagggtaatgctcaagcaatccttgatggtccatggaacgcagctaatattaagaagattttaggtaagaactttgcagttgctaagtatcctaagattgatgttggcggtaagaatgtacaaatggaagcattccttggtattgaaggcttcgcagttaactcaaacactaagaatgctaaagctgcttcagacttagctgcttacatcactaataagaagtcacaattgattgctcacaaagaagcaggtcaaattcctgtattaaaggctgcagttaactcaagtgcagttaagagtgatccagttgctgaagctgtaattgaaatggctaagccaggtaactcagtattgcaacctaagcttccacaaatggctgcattctggaatggttcagctccacttatcagtggtacttacgatggtaagattaagccaagtcaatacaaggcacaacttgctaaactcgcaaagactgttgaaaagaaa

SEQ ID NO: 66 - protein, 408 aa, Lactobacillus acidophilus
MKFWKKMALGSTAVLAAMSLAACSNGSSNSSSSSNTSNKKANLTLWVDTEQVPYYKQIAKDFTKKNKNIKVRVVQSPNGSANAKTDVGKDPSKAADVFEVPNDQLGQMAEAGYINPLSPSASKDIKANYIDVASKGVTWKGKVYAFSYAQQAQTIYYNKSKLSANDVKDWKTLTSKGVVATDFTNAYVMWPVMFSAGTKLYGNNGEDLKGSTFNSQDGINALKWYAAQKKNKGVMQTSNALNQLKKGNAQAILDGPWNAANIKKILGKNFAVAKYPKIDVGGKNVQMEAFLGIEGFAVNSNTKNAKAASDLAAYITNKKSQLIAHKEAGQIPVLKAAVNSSAVKSDPVAEAVIEMAKPGNSVLQPKLPQMAAFWNGSAPLISGTYDGKIKPSQYKAQLAKLAKTVEKK

SEQ ID NO: 67 - DNA, 1104 bp, Lactobacillus acidophilus
  CDS (1)...(1104)
  misc_feature (0)...(0): ORF 1867; Multiple sugar-binding transport ATP-binding protein msmK
atggttgaggttgatttaaaccatatttacaagaaatatgcaggtaacgatcggtattctgtaaatgactttaacttacacattaaagacaaggaatttatcgttttcgttggtccatcaggttgtggtaagtcaactacattaagaatggttgccggtttggaagatatcagtgaaggaactttggaaatcgatcataaagtaatgaacgatgttgctccaaaagaccgtcacattgcgatggttttccagaactatgctttgtatccacatatgaccatttatgacaacatggcatttggtcttaagcttcgtcacacacctaaggatgttatcgacaagaaggttaaagaagcagctaagatgttaggtctagaagattatctagataaaaagccaggtgctttatccggtggtcaaagacagcgtgttgcattaggacgtgcgatcgttcgtgccgcacctatcttcttaatggatgaaccattatcaaatcttgatgctaagcttcgtgtggtgatgcgtacagaaattgctaagcttcaccaagaattgggaactacaactatttatgttacccacgatcagactgaagcgatgactttggctgacagagttgttgttatgtctgttggtaaagttgagcaaatcgggtcaccacttgaggtttacaacaagccagtaaatatgtttgttgctggattcattggttctcctcaaatgaacttcttcaatgttcactataagaacggtcgaattagtgatggcaaagggttgaatattggtattcctgaaggtaaagcaaaattacttgaagaaaaaggatacaacgataaggacttagtcttcggtattcgtccagaagatattcactcagaagaagcatttatggaaacttggccagattcagtagttgaatcaaaagttgttgtttcagaacttttaggtgcaactattcaacttcaccaagaagtagatggcactgaatttactgcaatcgtaaattcacgtgatttccataaaccaggtgatatggtcaggatgggcttcgatgttaataaggctcacttcttcgataaggatagtacaaaagctatcgttaac

SEQ ID NO: 68 - protein, 368 aa, Lactobacillus acidophilus
MVEVDLNHIYKKYAGNDRYSVNDFNLHIKDKEFIVFVGPSGCGKSTTLRMVAGLEDISEGTLEIDHKVMNDVAPKDRHIAMVFQNYALYPHMTIYDNMAFGLKLRHTPKDVIDKKVKEAAKMLGLEDYLDKKPGALSGGQRQRVALGRAIVRAAPIFLMDEPLSNLDAKLRVVMRTEIAKLHQELGTTTIYVTHDQTEAMTLADRVVVMSVGKVEQIGSPLEVYNKPVNMFVAGFIGSPQMNFFNVHYKNGRISDGKGLNIGIPEGKAKLLEEKGYNDKDLVFGIRPEDIHSEEAFMETWPDSVVESKVVVSELLGATIQLHQEVDGTEFTAIVNSRDFHKPGDMVRMGFDVNKAHFFDKDSTKAIVN

SEQ ID NO: 69 - DNA, 1536 bp, Lactobacillus acidophilus
  CDS (1)...(1536)
  misc_feature (0)...(0): ORF 1944; putative sugar ABC transporter (ATP-binding protein)
atgacacaaaaaaatacaaatgccattgaaatgaagcatattgttaaaaaatttggtgactttaaggcaaacgatgacattaatctcacactccatcaaggggaaattttagctttacttggggaaaatggtgctggtaaatctaccctaatgcgaattttatcaggtttacttgaaccaacatcaggagaaatttttgtaaaaggtaaaaaagttgagattaatagtcctactaaagcaaaagaactaggaattggaatggtccatcagcacttcatgttaatggaatcattcacagtactggaaaatatcattttaggtcatgaacctactaacgggattgttcttgatataaaaaaggctcgagaacaaattatgaatctctcccaaaaatatggtctatcaattgatccagatgcaagagtcgcaaatattacggtagctcagcaacaaagagtagaaatactcaaagtgctctatcgtggtgctgatattcttatttttgatgaacctactgcagttttaactccccaagaaatcaccgaatttattcaaattattaaaaatttagctcaagaaggaaaatctattattttaattacgcataagcttagtgaaatcaaagcagttgcggatcaagtcacaattattcggcggggccatgatgtcggcacttttgatgtagataaagttgatgacaaccgcttagctgaattaatggttggccatcacgttaatatgaaacttgctaaaaagcctgttaaactaggtaaagaagtgctcaaagttgataacttgaaagttaaaaatagtcatggtgcatattctgtcaaaaatttatctttaaatattcggggtggggaaattttaggcttagctggaattgatggcaacggtcaagatgaactagttgaagctattactgggctacgtcacgttaatagcggaaaagtttttattaatggaaaaaatatgactaacaaaaaagttcgtcaaattaccgaagccggtgtagctcacatccctgccgaccgccaaaaatatggattaattttaagcttgcctttagccgaaaacttagttcttcagacttactatcaaaagccatactccaaacacgggattattaatcatcaagcaatttatgatcatgccgaaaaactgattaaaaaatatgatattcgaactactagcgcagaacttcctgcaagtgatctatcaggtggtaatcaacaaaaagcaattattgctagagagttagatcgagacagcgatttaattattgcttttcagccaacacgtggattagatgttggggcgattgaatatattcataaacaacttttagctgaaagaaatgccggtaaggctatcttacttgtttcatatgagcttgacgaaattatgcaattgtccgatcggattgcagttttacataatggtcaaattacaggtgaagttaaacctgaagatacaaatgacacagaacttggtcttttgatgaccggaactaagaaagaaggcgcagtaaatgat

SEQ ID NO: 70 - protein, 512 aa, Lactobacillus acidophilus
MTQKNTNAIEMKHIVKKFGDFKANDDINLTLHQGEILALLGENGAGKSTLMRILSGLLEPTSGEIFVKGKKVEINSPTKAKELGIGMVHQHFMLMESFTVLENIILGHEPTNGIVLDIKKAREQIMNLSQKYGLSIDPDARVANITVAQQQRVEILKVLYRGADILIFDEPTAVLTPQEITEFIQIIKNLAQEGKSIILITHKLSEIKAVADQVTIIRRGHDVGTFDVDKVDDNRLAELMVGHHVNMKLAKKPVKLGKEVLKVDNLKVKNSHGAYSVKNLSLNIRGGEILGLAGIDGNGQDELVEAITGLRHVNSGKVFINGKNMTNKKVRQITEAGVAHIPADRQKYGLILSLPLAENLVLQTYYQKPYSKHGIINHQAIYDHAEKLIKKYDIRTTSAELPASDLSGGNQQKAIIARELDRDSDLIIAFQPTRGLDVGAIEYIHKQLLAERNAGKAILLVSYELDEIMQLSDRIAVLHNGQITGEVKPEDTNDTELGLLMTGTKKEGAVND

SEQ ID NO: 71 - DNA, 1149 bp, Lactobacillus acidophilus
  CDS (1)...(1149)
  misc_feature (0)...(0): ORF 1945; sugar ABC transporter permease protein
atgattaaggtcactcctaaggtgaaaaatatattagtgcctgctatttcaattatcgctggatttttagttggtgcactaatcatgctagcttggagctacaatcctatcgaagcttatagctcaatgttttcaagcgcattaggtaatatgaacggaattggggaaactatccgaggtgcaacacccttaatttttattgcggtgggttttgcagttgcttctaaagctggcttcttcaatatcggcttaccgggacaagctcaagccggttggcttacttcagtttggattgctcttgctttttctcacttacctagctacatcttattacctttcgccattatcagcggtgcacttgctggagctataatagctggaattgctggatacttacgtgctcaatttggtactaacgaagttatttctactattatgcttaactatattgtgctatatgtatgtcaatatttaatgcaacaaataatgccagcaagtttacgaacaggaacagataccacaaaaacaattccagtaaatggtagtttaaaaattggctggttgtcatcaatgtttggtgattcaagaattaatggcggtatctttttagccctgattggattaattctttactggtactttatgaagaaaactaccgcaggttttgaaatcaaggccgttggtcttaatccctttgccagtcgttatgcaggtatgtcatctaagaaaaacattattgtttctatgttgatctctggtgcattttcaggtcttggcggtgtcgcacaaggtcttggaacttatcaaaattattttactcaaacaagtagtgtagatatcggctgggatggactttcagttgcacttctaggtggcggaactgccttaggaattttacttgctgctattttattctcggttttaaaaattggtggtctcggaatgcagactattgcgggaatcccttacgaaattgtttctatcgtaattgcagcaattattttctttatcgctattaactatgtcactggtttgatttttaaaactaagaaaaataaaagtaaatactacatccctactcgtaaagaaaaaggaccaaacaatggcgttgatggtcctggtaaaaaagtaattgaagggagcgttgac

SEQ ID NO: 72 - protein, 383 aa, Lactobacillus acidophilus
MIKVTPKVKNILVPAISIIAGFLVGALIMLAWSYNPIEAYSSMFSSALGNMNGIGETIRGATPLIFIAVGFAVASKAGFFNIGLPGQAQAGWLTSVWIALAFSHLPSYILLPFAIISGALAGAIIAGIAGYLRAQFGTNEVISTIMLNYIVLYVCQYLMQQIMPASLRTGTDTTKTIPVNGSLKIGWLSSMFGDSRINGGIFLALIGLILYWYFMKKTTAGFEIKAVGLNPFASRYAGMSSKKNIIVSMLISGAFSGLGGVAQGLGTYQNYFTQTSSVDIGWDGLSVALLGGGTALGILLAAILFSVLKIGGLGMQTIAGIPYEIVSIVIAAIIFFIAINYVTGLIFKTKKNKSKYYIPTRKEKGPNNGVDGPGKKVIEGSVD

SEQ ID NO: 73 - DNA, 954 bp, Lactobacillus acidophilus
  CDS (1)...(954)
  misc_feature (0)...(0): ORF 1946; putative sugar ABC transporter (permease protein)
atgaatttcattaccataatggccttaattgtttcatcaacattggtttattctgcaccacttattcttacttccttaggtggcgtttatagtgaaaattctgggatcgttaacattggccttgaaggaattatgactatcggtgcctttgcagctatcgtattcaacctatcatttgcctcatcattaggtagtttaaccccttggattgctgctttagtaggtgggattgctggattgatcttttcaattcttcatgctgtcgcaactattaatttccacgctgaccatattatttcaggtactgtattaaacattatggcaccccctcttggcgtatttttaatcaaagctatctatgataagggtcaaaccgaaaatattactgctaactttggatactttagttttcccggtttaagtagtattcctgtaatagggccgattttcttcaaaaacacttcagctcccgcttggatcgctattttattagctatttttatgtggtggcttttatacaaaactcgtcttggtttacgtcttcgctcttgtggtgaaaatcctcaagcagcagatacaatgggtatcaacgtttacaaaatgcgttacatcggtgttttaacttctggtttcatgggtggccttggcggtgctatttttgcagaagctatctcaggtaacttctctatttcaactatcgttggtcaagggtttatggccttagcagctgtaatctttggtaaatggaatccaattggtgctatgctttcatctgtattttttggctttgcccaaagtttaagtattatcggaaatcaactaccaattatttcaaatattccagctgtttacatgcagattgctccttatgttcttacaattatcgttttagttctcttcttaggaaaatctgttgctcctgcagctgatgggatcaattatatcaaatctaaa

SEQ ID NO: 74 - protein, 318 aa, Lactobacillus acidophilus
MNFITIMALIVSSTLVYSAPLILTSLGGVYSENSGIVNIGLEGIMTIGAFAAIVFNLSFASSLGSLTPWIAALVGGIAGLIFSILHAVATINFHADHIISGTVLNIMAPPLGVFLIKAIYDKGQTENITANFGYFSFPGLSSIPVIGPIFFKNTSAPAWIAILLAIFMWWLLYKTRLGLRLRSCGENPQAADTMGINVYKMRYIGVLTSGFMGGLGGAIFAEAISGNFSISTIVGQGFMALAAVIFGKWNPIGAMLSSVFFGFAQSLSIIGNQLPIISNIPAVYMQIAPYVLTIIVLVLFLGKSVAPAADGINYIKSK

SEQ ID NO: 75 - DNA, 1350 bp, Lactobacillus acidophilus
  CDS (1)...(1350)
  misc_feature (0)...(0): ORF 45; sugar transporter, putative
atgagaagaggaaaaaacttggagcaaaagaaatcaggattgcccacacttgctagtaccacgatttggatgattagcttaggatatttgggtgtacaaattgcatttactttggaaacttcacaaatgagtagaattttccaaacgttaggagctgatccaacaaaattaggctggttctttatcttaccacctttagctgggcttttagttcaaccaggaattggatctttatcagatcgtacttggattcctaaaattggtcgtcgtttgccatatttattgatcggaatggtttttgctgtaataacaatgatcattttgcctaatgtaggtagtttcggtttaggttatggttctttagaagcactcgtttttggtgctgttgcaatcgctgtattggatgttgcttctaatatggcgatgcaaccatttaaaatgatgattggtgatatggttaatgacgatcaaaagtcatatgcctatggtattcaaagtatgctttcaaactttggtgctgtaattgctgcattcttcccatttttattaaccagtttaggtgttgctaatactgctaagaagggtgtagtacctcaatctgttgtaatctcattttatgttggtgcagctgttttagtagtaacttcattatttactatttttagagttcatgaatatgatccagaaacttatgcacgttatcacggaattaaggaatcagataataaagaaggcggcggctggattgaattattaaagaaagcccctaaagtgttttggcaagtttcattagttcaattctttagttggatttctttccaatatctttcaacttatgcgactggagcaattgcacaaaacgtatggcatactacttctgcgtcttcatctggttaccaaattgctggtaattggtttggtgtattgactgctgtccaatcaatcgcagctgtgatttggtcatatgttttggctaaggtgccaaataatcatcataaattaggttatggtgtaagtttattcttaggagctattggttatacatcaatctttttagttcattcacaaatgatgttaattgtttcctttattttaattggaatcagttgggcaggtatgaatacttatcccttaactatggtatctaatgctttatctggtaaacatatgggaacatatcttggtttgtttaattgttctatttgtttaccgcagattgtagcttcactacttagctttatcattttcccacttgtaggaaattcaatgccagctatgatgttgattactggtatctcaggatttttagctgcattgtcagtaattagtattaaagaaacctatgtaaaa

SEQ ID NO: 76 - protein, 450 aa, Lactobacillus acidophilus
MRRGKNLEQKKSGLPTLASTTIWMISLGYLGVQIAFTLETSQMSRIFQTLGADPTKLGWFFILPPLAGLLVQPGIGSLSDRTWIPKIGRRLPYLLIGMVFAVITMIILPNVGSFGLGYGSLEALVFGAVAIAVLDVASNMAMQPFKMMIGDMVNDDQKSYAYGIQSMLSNFGAVIAAFFPFLLTSLGVANTAKKGVVPQSVVISFYVGAAVLVVTSLFTIFRVHEYDPETYARYHGIKESDNKEGGGWIELLKKAPKVFWQVSLVQFFSWISFQYLSTYATGAIAQNVWHTTSASSSGYQIAGNWFGVLTAVQSIAAVIWSYVLAKVPNNHHKLGYGVSLFLGAIGYTSIFLVHSQMMLIVSFILIGISWAGMNTYPLTMVSNALSGKHMGTYLGLFNCSICLPQIVASLLSFIIFPLVGNSMPAMMLITGISGFLAALSVISIKETYVK

SEQ ID NO: 77 - DNA, 1485 bp, Lactobacillus acidophilus
  CDS (1)...(1485)
  misc_feature (0)...(0): ORF 552; multidrug transporter
atgttgaaacaggggataagaatgaataaaaagcaaattatgatggttacgattgcgctaatgctaggaaatgttatgtcgggtcttgatggaacgattattaatacagctattccagcgattgttgctgcattacatggaattcaatttatgggctggattgtagcgatctttttgttaggaatgtcaatttctatccccatttggactaaagtaggagaaaagattactaacaagcgtgcatttgaaatttcgttggtcttatttgtagttggatcaactttgcaaggtatagctcctaacattattttcttcttatgttctcgatttatcatgggtattggtgccggcggtatggggtctctaccttacataattgctggttatgtttttaaaaatattaagactagaactaaggtgttaggatatttaactgctagttggaatggggctgctattttaggaccacttattggtgggtggttaattgatgctttttcatggcactgggtattttatattaatattccaattggattattagcaattattatctgcttggtttactacaaacctgttacaccagaaaagacaccagttttcgatatccctggtgcaagcttgttagttgtcagtttgttacttttcttaatgggtgtccaactcgttgggttaaccgctaactggattgtgattagtctaatcattgtcagcgtggtatttattattttattctttattcgggaaactcatgctgaaaatccgattattccgatatctttgtttaaaaacaaaaatcttgatggtgattttcttttatttgcctttacttggggagcatttattgctgttaacacttacttacctatgtgggcacaggcccttcttggcttatcagcccttcttggcggaatgactttaattcctaattcaattgtggagattattgcttctcaaagtgtagcggctattcaagagaaaatgacaacttttatgttggctcttattggtattattgctatgcttatttcttccggcggcttatacttagcagatttgcatacaccaattcaatttttaacttttattggtgctttttcaggaatcggagttggctttatcttcgttgctttgcaattaaaggtgcagcttgatgctggtcttaagaatatggcaacggctacttcaacttcatatttgattagaattttagctcaaacggtaatggccgcagtatatggcgtaattatgaacttgaatttagcaagcggcgttcatactcatcctggcattacaatggcaatgatgaataagttgagtgatgccaaaagtgctagattgttgccacagagtttggtgccaacaatgagaagtattttccattctgggattaaagaaattatgctagtttctgtggtcttgttggtgattgctttggtgttgaactgctactttaacttcggtaagaaacaaaagaaattacag

SEQ ID NO: 78 - protein, 495 aa, Lactobacillus acidophilus
MLKQGIRMNKKQIMMVTIALMLGNVMSGLDGTIINTAIPAIVAALHGIQFMGWIVAIFLLGMSISIPIWTKVGEKITNKRAFEISLVLFVVGSTLQGIAPNIIFFLCSRFIMGIGAGGMGSLPYIIAGYVFKNIKTRTKVLGYLTASWNGAAILGPLIGGWLIDAFSWHWVFYINIPIGLLAIIICLVYYKPVTPEKTPVFDIPGASLLVVSLLLFLMGVQLVGLTANWIVISLIIVSVVFIILFFIRETHAENPIIPISLFKNKNLDGDFLLFAFTWGAFIAVNTYLPMWAQALLGLSALLGGMTLIPNSIVEIIASQSVAAIQEKMTTFMLALIGIIAMLISSGGLYLADLHTPIQFLTFIGAFSGIGVGFIFVALQLKVQLDAGLKNMATATSTSYLIRILAQTVMAAVYGVIMNLNLASGVHTHPGITMAMMNKLSDAKSARLLPQSLVPTMRSIFHSGIKEIMLVSVVLLVIALVLNCYFNFGKKQKKLQ

SEQ ID NO: 79 - DNA, 1413 bp, Lactobacillus acidophilus
  CDS (1)...(1413)
  misc_feature (0)...(0): ORF 566; multidrug transporter
atgtcaggactagacgctaccattattaatactgcaattccggcaatcgtttctgatctacatggaattcaatatatgggctggatcgttgcctgcttcttgctagggatgtctgtttcagtgccaatttggagcaaattaggtgaaagaatgggtaataaatttgcttttgaactttcgctagtgctctttattttaggatcggtacttgaaggggtggcacctgatatttacttcttcctcatttcccgggtgttaatgggagtaggagctggcggcatgggctctcttccctatgttattgtcggctttatctatcctaatattaaacgaagaacggttattttgagttatatcgctgctagctttagtgcggcatgtattgctggacccttagttggtggctggatcgttgatgcactttcttggcattgggtcttttatatcaacgtaccattaggacttatttcaattattttaagtattgccttttatcgcgatgcccataagtctaaagaaaaagtacagtttgacaaaatgggtgcctttactttgattgcagggttgacctgctttttgattggtattcagatgttaggcttagcaagtaacgtaatggttgctttatttgtcattgtgggtattattttgcttattagctttatttttattgagaaaaaagcgaagagtcccattgttcccctaagtgtttttcttaataaagcacttgtcggcgactttgtattgtttgctttagcatggggtgcatatattgccgtcaatacttatttaccaatgtggtcacaggctattttaggtacatctgccttaattgggggaatgactttaattcctaactcgatcttagatattgccggttcgcagactgcaccatatttcttgcgacgttttagtaattatcatttgttaatcgttgattttactttgattgcaattaccattttagggttgattttagtaccgctaaatacttcatattggattttaatgcttattgcggctttttctgggttaggtgttggttcgatttttgttattttgcagattaaggtacagattgatgctagtgaaaaagacatggcaccagcaacttcgcttagttttttgattagaattttggctcaaacgatcatggcggccatttatggagtaatcatgaacttggctctagctagaggaatcgcgggtcaccgtggtattactatgaccatgatgaataagttgagtgatgcagagtcagctaagagtttaccgactgcaatgttgccaacaatgcggacaattttccattcgggaattattgagattatgtgtgttgctttattcttagtggtctgcgcatatgtcattaactttatttataatcgcaaagaagctaaaaaggtggcagaa

SEQ ID NO: 80 - protein, 471 aa, Lactobacillus acidophilus
MSGLDATIINTAIPAIVSDLHGIQYMGWIVACFLLGMSVSVPIWSKLGERMGNKFAFELSLVLFILGSVLEGVAPDIYFFLISRVLMGVGAGGMGSLPYVIVGFIYPNIKRRTVILSYIAASFSAACIAGPLVGGWIVDALSWHWVFYINVPLGLISIILSIAFYRDAHKSKEKVQFDKMGAFTLIAGLTCFLIGIQMLGLASNVMVALFVIVGIILLISFIFIEKKAKSPIVPLSVFLNKALVGDFVLFALAWGAYIAVNTYLPMWSQAILGTSALIGGMTLIPNSILDIAGSQTAPYFLRRFSNYHLLIVDFTLIAITILGLILVPLNTSYWILMLIAAFSGLGVGSIFVILQIKVQIDASEKDMAPATSLSFLIRILAQTIMAAIYGVIMNLALARGIAGHRGITMTMMNKLSDAESAKSLPTAMLPTMRTIFHSGIIEIMCVALFLVVCAYVINFIYNRKEAKKVAE

SEQ ID NO: 81 - DNA, 1236 bp, Lactobacillus acidophilus
  CDS (1)...(1236)
  misc_feature (0)...(0): ORF 567; multidrug transporter
ttgatactattgagacaaggggaggagtttattttgaaagaaaaacccatttggaagcgtaatttatctgtcttatcaattgcggtctttattgcagggatcgctttttcagaaattatgccttttttatcgttatacattaacacgttaggtaatttctctcaccaacaacttagtttctggtctgggatagtttattctggtacgttcattgtttcagcaatcgtctctccttggtggggcaaattagctgataaaaaaggacgcaagccgatgatcttacgagctggaattggaatgtcgcttgtaatagctagtatgggactagtgcaaaatgtttggcaactacttttactcagaatgttgcaaggggtatttgccggttttatttccaactccaatgcgttagtagctaccgaaacacctaaaataaattctggccaggctttagggactatcgcttcagctaccactgccggaactttgcttggaccgcttgttggtggtgctttaacttctattttttcataccgaattacctttatgatcactggcggcttgcttttaatctgctcaattttagtattattctttgttcatgaagatgacttcaagccagtcactactaaaaaattggataaagcaagtggtgtaatcaagtcgcttcgttcacctcatttaatttttggcttattattaaccaccttaattattcaagcagctaacaattcaattaatccaattgtttcactctatgtacgtcaattacttaatgaccacggcaatgttgtttttatttccggtatcattgctgctcttcctgggattgccacatttttagtagcatcccactttggcgcacttggtgataaaattggcactcataaaatcattgttgccggcttcatcgcagcatcaattttctttttcttaacggcttttgtacaaaacacagtcgaattaggaattttgcgctttttggttggcttttctgatgcttgcttattccctcaagttcaaacgatgttaactaaaaactctcctgccgctgtaacgggtcgtattttttcatggaatcagtcagccatgtatattggaaatattgtgggcccgctactaggatcatttgtatcagggatgtttaactatagtatggtctttattgtcactacagtaattgtgctgatcaatctacttcttttcagaatcaatgtcattcaaaatttggcaaaaaaa

SEQ ID NO: 82 - protein, 412 aa, Lactobacillus acidophilus
MILLRQGEEFILKEKPIWKRNLSVLSIAVFIAGIAFSEIMPFLSLYINTLGNFSHQQLSFWSGIVYSGTFIVSAIVSPWWGKLADKKGRKPMILRAGIGMSLVIASMGLVQNVWQLLLLRMLQGVFAGFISNSNALVATETPKINSGQALGTIASATTAGTLLGPLVGGALTSIFSYRITFMITGGLLLICSILVLFFVHEDDFKPVTTKKLDKASGVIKSLRSPHLIFGLLLTTLIIQAANNSINPIVSLYVRQLLNDHGNVVFISGIIAALPGIATFLVASHFGALGDKIGTHKIIVAGFIAASIFFFLTAFVQNTVELGILRFLVGFSDACLFPQVQTMLTKNSPAAVTGRIFSWNQSAMYIGNIVGPLLGSFVSGMFNYSMVFIVTTVIVLINLLLFRINVIQNLAKK

SEQ ID NO: 83 - DNA, 1386 bp, Lactobacillus acidophilus
  CDS (1)...(1386)
  misc_feature (0)...(0): ORF 753; transporter
atgaaagagaatactaaaaatatattagcagttttatctgctgcatttatgtcttttgtggggatactaactgaaacgagcctaaatgtaacttttccaacaatgatgaaagaatttaatgtaacgttagatacaatacagtggactaccacagggtatttattggcgattgcaattattatgatttgttcgtcctatttaaatgaacgctttacagctaagcaattgtttgtcgtagcatgtattggatttatggtaggtagtgtgataagtgcaattgcaccgaactttcccattttacttttaggtagattgatttcagctttaggtgcaggtcttagtacaccattaatgtttaacctagtgactgaaattatgccacgtgctaagtggggagcatatatgggaattgctgggttagttgtagctatggcaccaactttaggaccagcatttggtggtattgttactttttatttgaattggcgttacatttttgtgtttgtgacaatttttgcagttattgttttctttgctggtttaacggttattggtaagtatcatgaacaaagtaaaaatagttttgattggttatcatttattgttttagccgtttcatttatgactttaaccattggggtaaatcaaattggtaatggtattgctaacccgctattgtggattttattagtggtgacggttgtattaattggtggttttgtaaaattatcaaagtggtcatcaaaaaaattgcttaatttaggagtgttcaagcaaaaagcatttatttatggtgcattagcatattttttacttcagtttaataatatcggcattagttttgtgttacccaattatattcaaattgtaggaaagcaaagttcattaattggtggcttaattttacttccaggtagtatcattgcgggattacttaatccatattttggtagtttatatgataaaaaaggtgcacgtttacccctttatactggtggatttttgatggcaattagttgtttattatttgctattttcggtttgaatttaacttcaatgttaattattgttttctatggcattatgatgttgggacatagaatggcttttagtaatacaatggctgaagcgctaaaagtagaaaaaggaacgttacgtgcagatgcaacagcagtttgtcaaactagtcaacaacttgctggttcagttggaactacaattttagcttcaatcatgtctatttggcaaaaaagagctaatataccttatactctagcaaccgcagaaggaagtcgagcagcgttctggtttactttgctgattagtttaataattttatttagttattggaaaatgtttaaagtagaaaaaagtaagacagttaaa

SEQ ID NO: 84 - protein, 462 aa, Lactobacillus acidophilus
MKENTKNILAVLSAAFMSFVGILTETSLNVTFPTMMKEFNVTLDTIQWTTTGYLLAIAIIMICSSYLNERFTAKQLFVVACIGFMVGSVISAIAPNFPILLLGRLISALGAGLSTPLMFNLVTEIMPRAKWGAYMGIAGLVVAMAPTLGPAFGGIVTFYLNWRYIFVFVTIFAVIVFFAGLTVIGKYHEQSKNSFDWLSFIVLAVSFMTLTIGVNQIGNGIANPLLWILLVVTVVLIGGFVKLSKWSSKKLLNLGVFKQKAFIYGALAYFLLQFNNIGISFVLPNYIQIVGKQSSLIGGLILLPGSIIAGLLNPYFGSLYDKKGARLPLYTGGFLMAISCLLFAIFGLNLTSMLIIVFYGIMMLGHRMAFSNTMAEALKVEKGTLRADATAVCQTSQQLAGSVGTTILASIMSIWQKRANIPYTLATAEGSRAAFWFTLLISLIILFSYWKMFKVEKSKTVK

SEQ ID NO: 85 - DNA, 1470 bp, Lactobacillus acidophilus
  CDS (1)...(1470)
  misc_feature (0)...(0): ORF 1446; multidrug transporter
atgaataaacaacctgttgatattcatggtaaacactacaatcgtaacttattggtactagtattgatcgtcggctcattttgtacggtattaaacgggacacttttgtcaaccgcattgccttcaatcatgaaagatttcaatattagtacagccactgcggaatggctttctacagcattcttattagttaatggtgtaatgattccaatttctgcttggttaatcaaccgctttggttccaaaaagatgtatctgacggcaatgtctacattctttattggcactttaactgccgctctagcacccaactttcaaacgcttttagccggcagaattattcaagggcttggagtcggggttactatgccacttcttcaaacaattatgttatcaattttcccagcagataagcgtggcgctgccatggggacagtcggcatcgttatcggcttagcaccagctattggtccaacattatccggttgggtagttgataatctttcttggcgttaccttttcagtattatcgctccaattgccggaattgttgtaatacttgcagcatttttggtaaaagatgtcctaccaactaaagatgaaaagattgatattttctctgttgctacttcaactattggattcggctctcttctctatggcttttcagaagctggtaacaaaggctggactaatcctgaaattttagcatttattttcgttggaattatcttcgtaatcctctttggtattcgtcaattgaagatggacgatccattccttgatatcactgtattcaagcacttcgaattctcacttgctgctattctttcaggtgttactaacttggcaatggttggaatcgaaatggttttaccactttatattcaaaatttgcgtggtgagtctgcatttcactctggtttgattcttttaccaggtgccttgatgatcggtatcatgtcgcctattactggtcgaatttttgatcgttatggtgcaagaaagatggccatcacaggtatgacccttcttactttaggtactgttccatttatgtttttaactgaaaacagttccttcttaatgattattattctctacgcaatcagaatggtgggggtagcccttgttatgatgaatgttactacttcggggatgaactctcttccattggataagatttcacacggtactgcagttaacaatactttcagacaagttttatcatcaattggtactgctattcttgtttcagtattgactacaactactaagaacaatatgccagaaaagtcagtacttaagactttaccactccagtataagactggtgcaattaacgctacacttgatggtttccatgctgcatttgcaattagtatcatttttgcattgatcgccttagttctctccttcttcttaaagaaaggcaatcgtgcacgcgaacgtacagagaaggtggacagt

SEQ ID NO: 86 - protein, 490 aa, Lactobacillus acidophilus
MNKQPVDIHGKHYNRNLLVLVLIVGSFCTVLNGTLLSTALPSIMKDFNISTATAEWLSTAFLLVNGVMIPISAWLINRFGSKKMYLTAMSTFFIGTLTAALAPNFQTLLAGRIIQGLGVGVTMPLLQTIMLSIFPADKRGAAMGTVGIVIGLAPAIGPTLSGWVVDNLSWRYLFSIIAPIAGIVVILAAFLVKDVLPTKDEKIDIFSVATSTIGFGSLLYGFSEAGNKGWTNPEILAFIFVGIIFVILFGIRQLKMDDPFLDITVFKHFEFSLAAILSGVTNLAMVGIEMVLPLYIQNLRGESAFHSGLILLPGALMIGIMSPITGRIFDRYGARKMAITGMTLLTLGTVPFMFLTENSSFLMIIILYAIRMVGVALVMMNVTTSGMNSLPLDKISHGTAVNNTFRQVLSSIGTAILVSVLTTTTKNNMPEKSVLKTLPLQYKTGAINATLDGFHAAFAISIIFALIALVLSFFLKKGNRARERTEKVDS

SEQ ID NO: 87 - DNA, 1248 bp, Lactobacillus acidophilus
  CDS (1)...(1248)
  misc_feature (0)...(0): ORF 1471; multidrug transporter
atgcgagaaacgttaggaggaaaacttatgaacgttgaagaactaaaaaaatccaataagcataattggaaattaaaaattggaattctaggaatatctttattcttacaagttgcgggctctaacttggcagcaattccaatgattgctaaatcgtttccaaaagaatcagtaacttcgattcaagctttgtttacgattccatcgtttactattatgctttttattttatttagtaatgcggttattaaatgggtaggtaagcgtaacacagttattattggtatgattgccacaactatcggtggtgtaatgccattctttatcaataactttccattaattgtatttagtagattattagttggtgccggtatcggtttgtttacttcattagctgtatcacttatcggtgattgcttcagtggtgatgaacaaaagactttaattggtatccaaggggcaatgggaactttaggaaacagtgcatgtacttttatttctggtttacttttagggattaattggcaaactacattcctttatatgcttctcgtaattcctttcttaattttatttatgatgggatatacaagaaaaatggaaaagcaaactactgttgaaaagaatgatactaaagcaaataccaaagaaaaaagccatgctaaaattcctggcagaatttatattgcattcttcatgctgtttctatacttttcagcatttatggtcgaagcaacagcgtcagctttagtaattcaacaaaaccaacttgctaaccaaggagtattatctactgaaatagccgttgcaggattaattggtgctgtaatttcaatgggatacagtagaatatataaattattccataattacacaccagtaattactactatctgtggagctctcggatttatagtatgttcacaagcaagtaatatggcaattttctttgtgggattgttattaatgtttgtaagttcattaattattccatatgtatatgacactattttaagcgatgttgattcatctattagtaatttgattatttcgattgcacaagtatgtaacaacttaggtgctttcgcatccccatatgtcatcgcattcttaagtaatgtatgtcatttatctactcctgtggatcagatgagaataagtgcaggaattttattagtaattacaattgtattctttgcaatggctgttactcacaagaaagttaatacagttactaaagtagat

SEQ ID NO: 88 - protein, 416 aa, Lactobacillus acidophilus
MRETLGGKLMNVEELKKSNKHNWKLKIGILGISLFLQVAGSNLAAIPMIAKSFPKESVTSIQALFTIPSFTIMLFILFSNAVIKWVGKRNTVIIGMIATTIGGVMPFFINNFPLIVFSRLLVGAGIGLFTSLAVSLIGDCFSGDEQKTLIGIQGAMGTLGNSACTFISGLLLGINWQTTFLYMLLVIPFLILFMMGYTRKMEKQTTVEKNDTKANTKEKSHAKIPGRIYIAFFMLFLYFSAFMVEATASALVIQQNQLANQGVLSTEIAVAGLIGAVISMGYSRIYKLFHNYTPVITTICGALGFIVCSQASNMAIFFVGLLLMFVSSLIIPYVYDTILSDVDSSISNLIISIAQVCNNLGAFASPYVIAFLSNVCHLSTPVDQMRISAGILLVITIVFFAMAVTHKKVNTVTKVD

SEQ ID NO: 89 - DNA, 1644 bp, Lactobacillus acidophilus
  CDS (1)...(1644)
  misc_feature (0)...(0): ORF 1616; Polysaccharide transporter
atggaagaagaaaataacttaaatagcaaagatacacaaaatacctttctaaaaggttctgcgtggatgacttttggctcaattgcctcaagaattctgggagctttatatattattccgtggtatgcctggatggggcaatatggtaatatcgccaatgccttaactgcacgaagttataatatttatactatttttatcttaatttcgactgcaggtattcctggtgcgatcgctaaacaggtagcaaagtataatgctttaaatgaatatggaattgggcgtaggttattccataaaggattaattttgatggccattctaggggtggtttcagctgcaattatgtattttgcttcgccgcttcttgcttcaaatggtagtcaaagtgatccgaggcaaattgcggttatgcggagcttgtcatatgcaatcttgattatccctattttaagtattatgcgtggatattttcagggttatgcggatatgatgcctagtgcaatgtcgcagtttgtagaacaatttgcccgtgtcgtctggatgcttttgactgcttttgtaattatgcaagtccagcatgggtcatatgttcatgcagttattcaatcaaatttggctgctgcagttggagcagcatttgggattggattattagtctggtttttgttttcacgtaggaaacaattggattatctagtagctaattccaataatcggttacgtgtgtccactacagaattatttgcggaaattattgaacaggcaattccctttatcattattgactcagggattacattgttctcgttggttgatcaatatactttccatccaatgattgctgggttggttcatgcaagttcagatgcgatcgaagattggtatgcactatttggcttaaatgctaataaattaattatgattatcgtatctttagctagtgcaatggcagtaacagcaattccacttttgtcagctgctcatacaagaggtgactacaagagtatttctcgtcagattgctaatacgatggatttattcttgttcgtaatgattccagcggcatttggaatggctgccattagtcgaccgatttatacagttttttatggaccagatcaattaggtagtaatgttttatacttgtctgcttttactgcaatcagtttagggttgtttactgtattaatggcaattttgcagggactttcagaaaatggcctggcaattaagtatttagttctaggtttaattttaaaaggaattctacagtatccgatgatcttcttgtttaagatatatggtccacttgtagcaactaatttaggattattggtaatagttctgttgtcgctcaaacacttagaagttcagtataactttaacttaaatcgaactagtcggagattagtaggtattacagccttttcaattggaatgtttataattgttaaattggttgaaatgggattaggtaaattcttaagtcctgatcgaagaatttcagctttaattttagtaattgtagcagtaagtattggcataatattctatggctttgctgcattgaagacagatttagctcaaaagattatgggaagtaaaatcgaaagtattttggttaggttacgcatccatgat

SEQ ID NO: 90 - protein, 548 aa, Lactobacillus acidophilus
MEEENNLNSKDTQNTFLKGSAWMTFGSIASRILGALYIIPWYAWMGQYGNIANALTARSYNIYTIFILISTAGIPGAIAKQVAKYNALNEYGIGRRLFHKGLILMAILGVVSAAIMYFASPLLASNGSQSDPRQIAVMRSLSYAILIIPILSIMRGYFQGYADMMPSAMSQFVEQFARVVWMLLTAFVIMQVQHGSYVHAVIQSNLAAAVGAAFGIGLLVWFLFSRRKQLDYLVANSNNRLRVSTTELFAEIIEQAIPFIIIDSGITLFSLVDQYTFHPMIAGLVHASSDAIEDWYALFGLNANKLIMIIVSLASAMAVTAIPLLSAAHTRGDYKSISRQIANTMDLFLFVMIPAAFGMAAISRPIYTVFYGPDQLGSNVLYLSAFTAISLGLFTVLMAILQGLSENGLAIKYLVLGLILKGILQYPMIFLFKIYGPLVATNLGLLVIVLLSLKHLEVQYNFNLNRTSRRLVGITAFSIGMFIIVKLVEMGLGKFLSPDRRISALILVIVAVSIGIIFYGFAALKTDLAQKIMGSKIESILVRLRIHD

SEQ ID NO: 91 - DNA, 1455 bp, Lactobacillus acidophilus
  CDS (1)...(1455)
  misc_feature (0)...(0): ORF 1621; multidrug transporter
atgaaaaaaacaaacgtgccaatagtcacgcttgcgatttttatgacaacttttatgacagctattgaaggtacaatcgtttctacagcgatgccaacaattgtttccgatctagatggattagaaattatgaattgggttgtatcgatttttcttttgatgacagctgtctcaactcctttatatggaaaactggcggatagcattgggcgaaagccagtttttttatttggaattacattatttgtcattggatcgtcattatgtgggctagcgcaaaatatggttgaactcattttatttagagtaattcaaggattaggctctggtgctgttcaaccagtagcaattacaattattgcagatttatatactttgcaaaaacgtgccaaaatgttaggacttaattcgggtttttggggagtagcctcagttattgctccgcttttgggaggctttattgttcagcatttatcatggcattgggtattctatattaatgtcccaattggaattattgcctttttgctagttgtattttgcttaaaagaacctaaacacaatgccaagtcaaaattagatttacagggtacaatttggttagtaattttacttctagccttaatgttcttcttgcaggatttaggtgaagtaactaatttcgtaataatggctatcttagctgctttagtgatagtctcagtaattatgttctttagatcagaaaaacgcgcagaagatccaataatgccgttatcaatgttaaaagatagagagttcttggctttaaatttaattacattactgatttctggtgtggtaatagggtttgaattctatattccaacttggatgcaaggaattaatgggacaagtgcctcaattgctgggtttgctgtaacgcctagttcattaatgtggattgtaggttccttcttaattggcggaatgcttggtcgttgggggattaaaaaaacatatgattacatgctgctagttttagtactggctgatttagctctaattttagttccaatttatacatctttttgggtattttgtgtaattgctgcttttaatggaatagcttttggtgcaataactactgcttcacaagttcgttcccaagtactagtgcctaaagaggatattggtgtagcaacttcatttaatactttaatgaaatatttaggccaaacaatgatggtttcaatttatggaattgcatttaatactatggtcgttcaagggttaaataagcatccgcaattaaatcaatcaatgatgaacaaaatcgtatcagctgaaaaagcgaaaactttatcagtagaggcaataccgcaattgagacagatacttttaagcggattaaaggcggtttatgtagtttcgttaattgtaattattatttctcttgttttaaataggatatataaagatcgaaaaattaataat

SEQ ID NO: 92 - protein, 485 aa, Lactobacillus acidophilus
MKKTNVPIVTLAIFMTTFMTAIEGTIVSTAMPTIVSDLDGLEIMNWVVSIFLLMTAVSTPLYGKLADSIGRKPVFLFGITLFVIGSSLCGLAQNMVELILFRVIQGLGSGAVQPVAITIIADLYTLQKRAKMLGLNSGFWGVASVIAPLLGGFIVQHLSWHWVFYINVPIGIIAFLLVVFCLKEPKHNAKSKLDLQGTIWLVILLLALMFFLQDLGEVTNFVIMAILAALVIVSVIMFFRSEKRAEDPIMPLSMLKDREFLALNLITLLISGVVIGFEFYIPTWMQGINGTSASIAGFAVTPSSLMWIVGSFLIGGMLGRWGIKKTYDYMLLVLVLADLALILVPIYTSFWVFCVIAAFNGIAFGAITTASQVRSQVLVPKEDIGVATSFNTLMKYLGQTMMVSIYGIAFNTMVVQGLNKHPQLNQSMMNKIVSAEKAKTLSVEAIPQLRQILLSGLKAVYVVSLIVIIISLVLNRIYKDRKINN

SEQ ID NO: 93 - DNA, 597 bp, Lactobacillus acidophilus
  CDS (1)...(597)
  misc_feature (0)...(0): ORF 1853; multidrug transporter
ttgttttactttttggaaagagatgactttttgactactacaaaatcaactgcctttccagctggatggcataaagctttttataccttatggttaggctgttttattacaggaatgggctactcaatgacgatgccctttatttctttatttatttctgatctgggtaattatacaaaatttcaaattaatctttactcaggtttagcatttgccatgacatttattgcccaggcaattgtttcaccatattggggcaacttggctgaccgtaaaggtagaaaattaatgtgtatgcgtgcttcaggggttatggcattaactattaccctgactggtttagcaccaaacgctatatatatcgttgttatgcgttttattcaaggagcattttctggttatatcaataatgcaacagcattaatggctggagaaactcctcatcacagaagcggctgggtaatgagccaaatgatgatagccggaactgcaggtaacttagttggaccacttttaggcgtgctttatcaagtttctttggcaattggctcggcggtgcttggggatatcgtattccattctttattaccggattat

SEQ ID NO: 94 - protein, 199 aa, Lactobacillus acidophilus
MFYFLERDDFLTTTKSTAFPAGWHKAFYTLWLGCFITGMGYSMTMPFISLFISDLGNYTKFQINLYSGLAFAMTFIAQAIVSPYWGNLADRKGRKLMCMRASGVMALTITLTGLAPNAIYIVVMRFIQGAFSGYINNATALMAGETPHHRSGWVMSQMMIAGTAGNLVGPLLGVLYQVSLAIGSAVLGDIVFHSLLPDY

SEQ ID NO: 95 - DNA, 1614 bp, Lactobacillus acidophilus
  CDS (1)...(1614)
  misc_feature (0)...(0): ORF 1917; Polysaccharide transporter
ttgaataaaaaaatcctgtccggttcattttggctatcatttggtagtatcgtctctagaattctaggagttgtttatttaattccatggcttatcatgcttggcagctaccataatcagctaaatgcgcaggcgttattcaattcatcttatacgccatatgcgcttttcttatctattggtactgcgggcttaccttcagttattgcccgggaagtatcacaattaaattctcagaatagatataaagacagcctatatattacaaaattaggcttaattatcatgcttgtaatgggattagcatgtggtattttgttatacgctactgctcctataattgctaagaatagtccagtagattcagtagctagtgctactatttctatccgcgtattggttccagctgtaattattttgccatcaatgagtatggtaagaggatggtttcaggggaacaacgatatgaagccatacggcatttcccaattatgggaacaatttgcgcgcattctatttattcttttatctactttattagtgatcgaagtttttcatcataattatgtgacagcagtttattttagtgtattcggtgcatgtgtgggtgctattgccagttatttgtatctttttgcgtatatgcgcaagaagtggggatactataaggggttaattgaaaaaagtaaaccacgggctttaaacaatgtttatcgaagcttgcttaatctttggtatgcatcaataccatttgttttacttggttcattcattactgttacgcaattagttgatcaacttttattcaagcagattttgattagttttaaccatatgagtagccaatatgtgagctatttgtataccatattttcagctaatccaagtaagatcaccacagtaataatttctcttgctacagcagtttctgagactagtttgccacttttagctggtcttaagtataagtccaaggataatcaaggaagcattaaaaagctgcttttagagaactatcgccttcttctttttgtattacttccgttagtgtcacttgcagcatttgcttcttcgccaatttatacagtactattttctcatgatagtttgggtgcttattatttggtggaaaacattgtacaaagtctattagccggccttgtgatgaactcattaactttgcttctagcacttaatatgaacaaattggctgttggttatatgatttggggaattattgtcaagattgtattacaggttcctatgacgatgtttatgagtgcagatggtgcaattctttcaactgatattgccttcttacttgtaatcgtgcttagttatcataagcttgataaaacatatgatgttaacttgcatagcttgctgccgattgttgtagtaaatgaaatctacattatcttattatttatttaccaacttttaattggatatcatttcaatagtttaggaagaatgggaagcttcatctatttagcaatcttcggtttagtattcctaggaatttatatcttacttgctaatgtaatggggactagcgagacaatttttggcaaaaagatcggttaccgctattatcgttataaacattttgaa

SEQ ID NO: 96 - protein, 538 aa, Lactobacillus acidophilus
MNKKILSGSFWLSFGSIVSRILGVVYLIPWLIMLGSYHNQLNAQALFNSSYTPYALFLSIGTAGLPSVIAREVSQLNSQNRYKDSLYITKLGLIIMLVMGLACGILLYATAPIIAKNSPVDSVASATISIRVLVPAVIILPSMSMVRGWFQGNNDMKPYGISQLWEQFARILFILLSTLLVIEVFHHNYVTAVYFSVFGACVGAIASYLYLFAYMRKKWGYYKGLIEKSKPRALNNVYRSLLNLWYASIPFVLLGSFITVTQLVDQLLFKQILISFNHMSSQYVSYLYTIFSANPSKITTVIISLATAVSETSLPLLAGLKYKSKDNQGSIKKLLLENYRLLLFVLLPLVSLAAFASSPIYTVLFSHDSLGAYYLVENIVQSLLAGLVMNSLTLLLALNMNKLAVGYMIWGIIVKIVLQVPMTMFMSADGAILSTDIAFLLVIVLSYHKLDKTYDVNLHSLLPIVVVNEIYIILLFIYQLLIGYHFNSLGRMGSFIYLAIFGLVFLGIYILLANVMGTSETIFGKKIGYRYYRYKHFE

SEQ ID NO: 97 - DNA, 984 bp, Lactobacillus acidophilus
  CDS (1)...(984)
  misc_feature (0)...(0): ORF 399; SCR OPERON REGULATORY PROTEIN
atgcccgctaaattaagcgacgttgcccgagaagctggttgttctgtcacaacagtttcaagagtaatcaataatcatggctatttaagtcaaaaaacaaaggataaagtttttgcagcaatgcaaaagttaaattatcaacctaactctcttgcccgctccttacaggggaagaaattaaaactagttggattgatttttccagaaattactaacccattttttgcagaattagttcaagaaattgaatctgctttatttaagcaaaattataaagtgatcctttgtaacgcaggccgtgatcgacaaaaagaacgtgaatatttacggatgctacaagctaatcaggtagatggaattattgctggtgcccataatttagggattgaagaatacaaacaattaggcttgccaattgtttcttttgatcgaaaattatctgacaacgtccctatcgtaagttgtgataattatcaaggaattaagatggctacacatgagttaattcaaacaggatgtaagcatatttactttttgggtaataaccaaagaaaaggcaaccctactgatgaacggttagaagcttatcttgatgagacaaaaaaatacgatttcacaccgcatattcgttctgttgctttctctgattcttctaatataaaaaacatgcaaatccataacatgttagttgatgacaaacctgatggtgtagtatgtacagatgatttaacagctattttggttttacaagaagcccaaaaattagggattaaagttccacaagaattaaaagtaatcggttttgatggtacacaattagttcaaacttatcattcagaactatcaacgattgctcaaccaattgatgatattgctaccttattagtagatttattattaaaaagaattacaaatcccaagcaaaaatttgaaagcaaaaactatgttttaccagttaaattaattaaacgtgaaacaactgca

SEQ ID NO: 98 - protein, 328 aa, Lactobacillus acidophilus
MPAKLSDVAREAGCSVTTVSRVINNHGYLSQKTKDKVFAAMQKLNYQPNSLARSLQGKKLKLVGLIFPEITNPFFAELVQEIESALFKQNYKVILCNAGRDRQKEREYLRMLQANQVDGIIAGAHNLGIEEYKQLGLPIVSFDRKLSDNVPIVSCDNYQGIKMATHELIQTGCKHIYFLGNNQRKGNPTDERLEAYLDETKKYDFTPHIRSVAFSDSSNIKNMQIHNMLVDDKPDGVVCTDDLTAILVLQEAQKLGIKVPQELKVIGFDGTQLVQTYHSELSTIAQPIDDIATLLVDLLLKRITNPKQKFESKNYVLPVKLIKRETTA

SEQ ID NO: 99 - DNA, 1455 bp, Lactobacillus acidophilus
  CDS (1)...(1455)
  misc_feature (0)...(0): ORF 400; sucrose-6-phosphate hydrolase ScrB
atggaatggacaagagaaaaacgttatttaccttatagtaaatgggatgctgacacattacttcatttgcaagcacaagcagcaaactccccttaccaaatgcactatcatttacatccaatttctggattaatcaatgatccaaatggtttttcatattttaatggtgcttaccatctgttttatcaatcatacccatttggtgcagttcacggactaaaatcttgggttcacttcaagtcaaaagatttagtccattgggaaaatttaggtttagctattgagccagatacaatggctgattcacacggtgcctactctggctcagcccgtgaaatcgatggcaaattattcttaatgtacacgggtaaccaccgtgatgaaaactggattcgtactccttaccaaattggtgcttggatggataaaaatggcaaagtttctgataaaactatcctctttaagaatcctgaccacatcaccgaacatttccgtgatccacaaattttaaagaaaaacgacacttactatgcaattttaggtgcacaagataacgccgaaaaacatggtcacattgatgtatggaaatcaaaagatttaaagaattgggaagaattaggctatctagattttacggatcaagacatgggttatatgatcgaatgccctaatcttgttgaagtagatggtcatgtggtgttgattttctgtcctcaaggattagataaaaaagtagctgattatgatgatatctatccaaatatgtatgtcattgctgatggaatcgattttgaaaaccataaattaattaatccaggtccactacaaaatttggataaaggtttcgatgtatatgctactcaagcatttaatgcacttgatggaaaagcatatgaaatcagctgggtaggtttacctgatataacttatccaactgatgatgaaaattgggcaaattgcttaagtcaagttaaagaacttactatcaaaaatggtcaattaattcaaaaaccagttaagtcgatggctagtcttcataaaaatgaaaaagatgtagctgatcaagttgtttctgaaaatgctggtcaacaatatgaattagagcttacaattaaagctggccaaaaaggaaatctctatctagctgcaaatgacgatttaagtagtggattaaagatcagctttgatactaaaaacggacaattaattttagatcgttctattgctggtcaaaaagtagcagtagattatggtgaaaatagaactgccccacttcaacctgatagcgatgtaaaattaaatatttatattgatcattcattaattgaaatttttgttaatgacggtgaaaatgtattaactggtcgttatttcgctgatcaagcacattctaagattgcatttgataaaaagattaactttaacggtaaactttggaatatgaaaacaattctt

SEQ ID NO: 100 - protein, 485 aa, Lactobacillus acidophilus
MEWTREKRYLPYSKWDADTLLHLQAQAANSPYQMHYHLHPISGLINDPNGFSYFNGAYHLFYQSYPFGAVHGLKSWVHFKSKDLVHWENLGLAIEPDTMADSHGAYSGSAREIDGKLFLMYTGNHRDENWIRTPYQIGAWMDKNGKVSDKTILFKNPDHITEHFRDPQILKKNDTYYAILGAQDNAEKHGHIDVWKSKDLKNWEELGYLDFTDQDMGYMIECPNLVEVDGHVVLIFCPQGLDKKVADYDDIYPNMYVIADGIDFENHKLINPGPLQNLDKGFDVYATQAFNALDGKAYEISWVGLPDITYPTDDENWANCLSQVKELTIKNGQLIQKPVKSMASLHKNEKDVADQVVSENAGQQYELELTIKAGQKGNLYLAANDDLSSGLKISFDTKNGQLILDRSIAGQKVAVDYGENRTAPLQPDSDVKLNIYIDHSLIEIFVNDGENVLTGRYFADQAHSKIAFDKKINFNGKLWNMKTIL

SEQ ID NO: 101 - DNA, 1947 bp, Lactobacillus acidophilus
  CDS (1)...(1947)
  misc_feature (0)...(0): ORF 401; sucrose-specific enzyme II of the PTS
atggaccacaagaaagtggctgaacgagtaattaaagatgtgggtcgtgacaatattattgccggtgctcactgtgctactcgtttgcgtttagtattgaaagatgattccaaggttgaccaaaaggctctggataatgatccagatgttaaaggtacttttaaaactaatggtcaatatcaagtgattattggaccaggagatgttaatgacgtttatgacgaattcattaagatcactggattaaaggaattatcaactgatgacttgaagaaggtagcagctgaaggccaaaagaagaatcctatcatggacttcattaaacttttgtctgacatcttcgttccaattattccagctttagttgctggtggtttgttaatggcattgaacaatttcttaacttcacctggacttttcggtccgaagtcagttgttcaaatggctcctaacgttgccggaatatcaagtatgattcaggtaatgtcggctgctccatttatctttatgccaatccttgtaggtatgtcagcggcaaaaagattcggcgctaatcaattcctgggtgctacaattggtatgattatgaccaccccaggacttggtggtgcaactaaattctgggatatctttggcttacatgtcgcacaaactaattatcaatatcaagttattccagttttagtagctgtatgggtattgtcaatttttgaaaaatacttccataagcatttaccatctgcagttgactttacctttacaccacttctttcaattatgattactggtttcttaactttcactattattggaccagtatttaagggtgtatctgacgcaattactaatgctatcgtatggctttacgatactactggtgcctttggtatgggtgtctttggtcttagttattcagctattgttactactggtcttcaccaaagtttcccagctgttgaaactcaacttttggcagcctttgctaagaatccagcaagttctggtgactttatctttgttactgcatgtatggctaatgtagctcaaggtgctgcaactttcgcagtctacttcttaactaagaacaagaagatgaaaggcttggcaagttcctcaggtgtttcagcccttcttggtattactgaaccagcattattcggtgttaacttaaaatacaaattcccattcttctgtgctttgattggttcaggtgttgcagctgcttttgcagggttgatgcacgtaactgctgccgcacttggttcagctggtttccttggttttctttcaatttatccaagaactattccaatgtgggttgtttctgtagcaattagttttgcagtttcattcattctcacttatgtttatggtaagagccacttgaaggaagaagtcgctgaacaagatgttccagtaaatgatgcaactgactacgctgaagaaactcaaaaagctgaaaagattggtaaagaacaattagcattaaaggatgaaattatttactccccagttgacggtactccagaaagcttaactaaagttaatgatcaagtattctcagctaagttaatgggtgacggtgccgcagttattccaagtgacggcactatctatgctccagtaactggtactgtaacaattgcttatgaaactaagcatgcttatggtattaaatcagatgatggtgctgaagtattaattcacattggtcttgataccgtaaaccttaagggtgaacactttgaaagctttgtaaaacaaggtcaacgtgttgaaaaaggcgacaagcttggcagcgttgatttagatgctgttaagaaggcaggttatgacactactgtcatggttgttattactaacactgccaactatgcaaatgttcaacgcattactgatgcaggtgacaagcacggtgataagctgattgctgttactgctcacgaa

SEQ ID NO: 102 - protein, 649 aa, Lactobacillus acidophilus
MDHKKVAERVIKDVGRDNIIAGAHCATRLRLVLKDDSKVDQKALDNDPDVKGTFKTNGQYQVIIGPGDVNDVYDEFIKITGLKELSTDDLKKVAAEGQKKNPIMDFIKLLSDIFVPIIPALVAGGLLMALNNFLTSPGLFGPKSVVQMAPNVAGISSMIQVMSAAPFIFMPILVGMSAAKRFGANQFLGATIGMIMTTPGLGGATKFWDIFGLHVAQTNYQYQVIPVLVAVWVLSIFEKYFHKHLPSAVDFTFTPLLSIMITGFLTFTIIGPVFKGVSDAITNAIVWLYDTTGAFGMGVFGLSYSAIVTTGLHQSFPAVETQLLAAFAKNPASSGDFIFVTACMANVAQGAATFAVYFLTKNKKMKGLASSSGVSALLGITEPALFGVNLKYKFPFFCALIGSGVAAAFAGLMHVTAAALGSAGFLGFLSIYPRTIPMWVVSVAISFAVSFILTYVYGKSHLKEEVAEQDVPVNDATDYAEETQKAEKIGKEQLALKDEIIYSPVDGTPESLTKVNDQVFSAKLMGDGAAVIPSDGTIYAPVTGTVTIAYETKHAYGIKSDDGAEVLIHIGLDTVNLKGEHFESFVKQGQRVEKGDKLGSVDLDAVKKAGYDTTVMVVITNTANYANVQRITDAGDKHGDKLIAVTAHE

SEQ ID NO: 103 - DNA, 2001 bp, Lactobacillus acidophilus
  CDS (1)...(2001)
  misc_feature (0)...(0): ORF 1012; PTS system trehalose specific enzyme
ttgacaacttgtatatacaagtttaatataatagctaaatctaatgaaaacgctttatacaggagaaaaacaatgaatgaaaacaatgaaattgcaattctcgctcccgcaagcggtgaagtaattgcattaagtaaaacaagtgatccaatctttagtaaaggtgcaatgggacaaggatttggtcttacaccatctgatggtgaagttgttgcaccaataagtggaaaagtttcaatgattgcagatactaaacatgctattggaataaccacagatgatgggcttgaagtattagttcacatgggagttgatacagttagtcttaagggagagccttttgaagttttagttaaaaatggtcaaactattgaagccgggcaagatattgccacaatgaatcttaaagccattaaaagtagcaatcttgatactaccattatggttttaatcacaaactcaaatgataagcttgagggtttagacgtttctgaaggtcctgctagaactggcgacgttatagctcatgcatacctaaaagtagaacaaaagaatacctcaaatcaaaagctttcatatgatgaactggcaacttttatcataaaaaatgttgggggcaaagataatattaacaatttaattcactgtatcactcgtctacgcttctacttgaaagatgaaagtaaagctaatgacgaagcattaaagaatcaacgtggtattcttgatgttatgcatgctggtggtcaatatcaagttgttatcggaaatgaagttactaatgtttatgatgcagtaatgaaacagcttcctaatttaagtgatcaacctgctccacaaactaatgaaaatgatgaccgtaatcctgtttcaaaggcatttggcaacttgatcggctttattactggttcaatgagtccagtaattggcgtaatcgctgcatcaggtattattaaaggatttttggctttactcactcttccacaacttggagcattattaaacgttaaaagtcctgtctatataacagttagtgcaatggctgactcagcattcttcttcctaccaattttagttggattctcggctgctaaacgacttaatagtgatccaattattgcagctgtaattggtggttttattacttatccccaaatgattagttggggtactgcgggtaagatgatgtttaatctaggtaattggaacttccaattcttaaactacagttactcaatctttccaatgatcttggctgcatggcttgctgctaaatgcgaagattggcttaagaaaattttaccaagctatttacaaatgattttcgtaccattaattactattttagctgtatcaaccatcactttagtaattacggggccagttattcaaggtgctgctaacggcatcgcagtatttattaattggttagtatcatcatcaggttggatcggcggcttagtaatcggtgccttttaccaactacttgttatcttcggtcttcactggggtgttgtaccactggtcgctcaacaaattgcttctactggtcaaagttcattaaatgcaattatttgttcaactatgatcgctcaaggtgctgccgttttagctgttgcagttaagtcaaagaaggctgacatgaaagaattaggtattgcagctgctatctcagcattctgcggtgttaccgaaccagcgatttatggaattaacttaagatacaagaaagtttttgcttcaggctgtgtcggttcagcatttggtggtcttgtaaccggtcttatgcatggtacaatgtacggttttactggtggtctaattggattttctagtttcttcaatccggctcatcctactcaactaaacagtttctacacattcttaatcgctagtgctgtttctattgtggttgcattcattgttacctgggtttggggctataatgataatatgaccatgggtaaaaaagttgaaaagaaacaacgtccaggtactaag

SEQ ID NO: 104 - protein, 667 aa, Lactobacillus acidophilus
MTTCIYKFNIIAKSNENALYRRKTMNENNEIAILAPASGEVIALSKTSDPIFSKGAMGQGFGLTPSDGEVVAPISGKVSMIADTKHAIGITTDDGLEVLVHMGVDTVSLKGEPFEVLVKNGQTIEAGQDIATMNLKAIKSSNLDTTIMVLITNSNDKLEGLDVSEGPARTGDVIAHAYLKVEQKNTSNQKLSYDELATFIIKNVGGKDNINNLIHCITRLRFYLKDESKANDEALKNQRGILDVMHAGGQYQVVIGNEVTNVYDAVMKQLPNLSDQPAPQTNENDDRNPVSKAFGNLIGFITGSMSPVIGVIAASGIIKGFLALLTLPQLGALLNVKSPVYITVSAMADSAFFFLPILVGFSAAKRLNSDPIIAAVIGGFITYPQMISWGTAGKMMFNLGNWNFQFLNYSYSIFPMILAAWLAAKCEDWLKKILPSYLQMIFVPLITILAVSTITLVITGPVIQGAANGIAVFINWLVSSSGWIGGLVIGAFYQLLVIFGLHWGVVPLVAQQIASTGQSSLNAIICSTMIAQGAAVLAVAVKSKKADMKELGIAAAISAFCGVTEPAIYGINLRYKKVFASGCVGSAFGGLVTGLMHGTMYGFTGGLIGFSSFFNPAHPTQLNSFYTFLIASAVSIVVAFIVTWVWGYNDNMTMGKKVEKKQRPGTK

SEQ ID NO: 105 - DNA, 723 bp, Lactobacillus acidophilus
  CDS (1)...(723)
  misc_feature (0)...(0): ORF 1013; transcriptional repressor of the trehalose operon
atgacggaatcaaaatcagacattattgcacaagatattgctgctaaaatacagcatcaacaatttaaagctggtgagttacttccaagtgagagtcaattaacaacactatatggtacatctcgcgagacagttcgtaaggcgttgaatcaattaactgcgttgggtctaatacaaaaaatacgtggaaaaggttcaatagttttaaatttagaaaaatattcttttcctatttctggaattactagtttcgctgaattgaataaatctttaaacatgcatgcagaaacaaaagtaatcacattaaaaaagatggttgatttaccagaattttttaaggaaaaatttccagagcaaaaaaggcaaccaggaatctatgttgaaagattgcgtgtagttaataatgagcctgtcgtattagattgtgattatttgttttcaccaccaattgatgaattaccaaaagaggcagcagaaaaatctatttatgattatattgaaaataaacttaaattagatatttcatatgctacaaaggtaattacagttgaaaaaattgatgataaatttaaaaagttattacaactggatgatagtttagctgtattagtagccagtcataatttcttgaatgacactacgttattccaattgacattatctttccataatccaagtaaatttaaatttgttgattttgcaagaagacagaagattaaattg

SEQ ID NO: 106 - protein, 241 aa, Lactobacillus acidophilus
MTESKSDIIAQDIAAKIQHQQFKAGELLPSESQLTTLYGTSRETVRKALNQLTALGLIQKIRGKGSIVLNLEKYSFPISGITSFAELNKSLNMHAETKVITLKKMVDLPEFFKEKFPEQKRQPGIYVERLRVVNNEPVVLDCDYLFSPPIDELPKEAAEKSIYDYIENKLKLDISYATKVITVEKIDDKFKKLLQLDDSLAVLVASHNFLNDTTLFQLTLSFHNPSKFKFVDFARRQKIKL

SEQ ID NO: 107 - DNA, 1710 bp, Lactobacillus acidophilus
  CDS (1)...(1710)
  misc_feature (0)...(0): ORF 1014; trehalose-6-phosphate hydrolase
ttgttgattttgcaagaagacagaagattaaattgtaaggagaaaagtatgattaatttaggcaaaaaaataatttatcaaatttatcctaaatctttctatgattcaaatggcgatggggtaggagatcttcaaggaatcattcaaaagattgattatattaagaagttaaatgtagacatgatctggtttaatccattttttgtttcaccgcaaaatgataatggttatgatattgctgattattacaacattgatcctcgctttggtacaatggctgattttgagaaattggtaaagaagctgaaagaaatcggtgtgggtgtaatgctagatatggtgctcaatcactgctcaactgaaaatatttggtttaaaaaagcacttgctggcaatgaaaagtatcgtaaatttttctacttgagaaaaggaaaaaacggaggtttacctaataattggcaaagtaaattcggtggtactgcttggtcaaaatttggtgataccgattactactaccttcacttgtatgatccaactcaagcagatcttgattggcataatcctgaagttcgtaaagaattatttaaagtggttaacttttggcgtagtaaaggtgtccatggcttccgctttgatgtaattaatgttacgggtaaagcggaaaaactagttgattcaacagatcctgtagaagaaaagagtttgtacactgatactccaattgttcataaatacttaaaagagcttaatgctgcaacttttggtcaagaccctgaatcaattactgtgggagaaatgtcatcaacgacgattgccaactcaattgaatattcaaaaccaagtgaacatgaattatcaatggttttcactttccatcatttgaaagttgactatcaggatggtgaaaagtggtctaagatgccatttgattttatgaaattaaaggaattattcactgaatggcaagaaaaaatggatcaaggtgatggctggaacgcattattctgggacaatcatgatcagccttgggcattaactagatttggtgatactggtaagtatcgtggaaagtcagctgaaatgcttgccacagcaactcatcttatgcggggaacaccatatatttatatgggtgaagaaattggtatgattgatcctgattattcttcaatggatgattacgtagatgttgaggccaagaatgcttttaaggctttaactaaaaaaggtttgagtgataaagaagcttttgaaatagttaaatcaaaagctcgtgacaattcacgtgtaccaatgcattggaatagtgaaaaatatgcaggttttagtgaacataagccgtggctcataccaactgatcaagaaaaaattaatgttgaagaggaattagcacatggtgaaatttttaattactatcaaaagttaattaagctgcgtagaagcgaagatttaatctctgatggtcatattaagatgttcttgaaagatgatccgcaggtttttgcttatgaacgctacttaaaagatagtgataaaaagttattggtatttactaacttctatggtaaagaacatagtgttaaattacccgaagaatatcaaaacaaagaataccaagttttaattaacaattatgatactaaagatagccaattaaccgatgaaattatattgaagccatatgaagcattagctattaaaattaaacaa

SEQ ID NO: 108 - protein, 570 aa, Lactobacillus acidophilus
MLILQEDRRLNCKEKSMINLGKKIIYQIYPKSFYDSNGDGVGDLQGIIQKIDYIKKLNVDMIWFNPFFVSPQNDNGYDIADYYNIDPRFGTMADFEKLVKKLKEIGVGVMLDMVLNHCSTENIWFKKALAGNEKYRKFFYLRKGKNGGLPNNWQSKFGGTAWSKFGDTDYYYLHLYDPTQADLDWHNPEVRKELFKVVNFWRSKGVHGFRFDVINVTGKAEKLVDSTDPVEEKSLYTDTPIVHKYLKELNAATFGQDPESITVGEMSSTTIANSIEYSKPSEHELSMVFTFHHLKVDYQDGEKWSKMPFDFMKLKELFTEWQEKMDQGDGWNALFWDNHDQPWALTRFGDTGKYRGKSAEMLATATHLMRGTPYIYMGEEIGMIDPDYSSMDDYVDVEAKNAFKALTKKGLSDKEAFEIVKSKARDNSRVPMHWNSEKYAGFSEHKPWLIPTDQEKINVEEELAHGEIFNYYQKLIKLRRSEDLISDGHIKMFLKDDPQVFAYERYLKDSDKKLLVFTNFYGKEHSVKLPEEYQNKEYQVLINNYDTKDSQLTDEIILKPYEALAIKIKQ

SEQ ID NO: 109 - DNA, 1110 bp, Lactobacillus acidophilus
  CDS (1)...(1110)
  misc_feature (0)...(0): ORF 1439; Multiple sugar-binding transport ATP-binding protein msmK
atggttagagtagatttagatcacgtttacaaaaagtatgacggtaatgataagaattcagttacagattttaatttacatattaaagatgaagaatttatcgttttcgttggtccatcaggttgtggtaagtcaactactttaaggatgattgctggacttgaagatatctccaaaggaacgttgaaaattggcggtaaggtaatgaacgatatagctcctaagaatcgtgatattgccatggtattccagaactatgctttgtacccccatatgagtgtatatgacaacatggcttttggattaaaactacgtcatacaacaaaagaggagattgataaaaaggtaaaaagagctgccaaaattttgggcttgtcagattacttgaagcgtaagccagctgcactttctggtggtcaaagacagcgtgttgccttaggtcgtgcaattgtgcgggatgcacctattttcttaatggacgaaccactatccaaccttgatgctaagcttcgtgtaacgatgcgtgccgaaattgctaaattacatcaacaattgaagactactactatttacgtaactcacgatcaaactgaagctatgactttagcagaccgcatcgtaattattaaagatggtattcaacaacaagttggtactcctctagaagtttacaacaaacctgctaatgtctttgtcgctggttttattggttcaccagctatgaacttcttccgtgtaattttaaaagatggaaagatcatcgataaagaacaccatgactttgaaatccccgttccagaaggtaaattaaaagttttgaaggacaaaggctacaatggtaaagaattaatctttggtatccgtcctgaagatgttcatactgaagaagtatttttggaaagtttccctgatcaagttgttactgctaaagtcgtcgtttcagaacttttaggcgcagaaactcaactttacaccaaagtaggcgatactgaattagtttcaaaggttgatgctcgtgacttcactaagccaggtactgaagtacgaatgggatttgaaatgaacaaggctcactttttcgatccagaaacagaaaaagttgttgagaat

SEQ ID NO: 110 - protein, 370 aa, Lactobacillus acidophilus
MVRVDLDHVYKKYDGNDKNSVTDFNLHIKDEEFIVFVGPSGCGKSTTLRMIAGLEDISKGTLKIGGKVMNDIAPKNRDIAMVFQNYALYPHMSVYDNMAFGLKLRHTTKEEIDKKVKRAAKILGLSDYLKRKPAALSGGQRQRVALGRAIVRDAPIFLMDEPLSNLDAKLRVTMRAEIAKLHQQLKTTTIYVTHDQTEAMTLADRIVIIKDGIQQQVGTPLEVYNKPANVFVAGFIGSPAMNFFRVILKDGKIIDKEHHDFEIPVPEGKLKVLKDKGYNGKELIFGIRPEDVHTEEVFLESFPDQVVTAKVVVSELLGAETQLYTKVGDTELVSKVDARDFTKPGTEVRMGFEMNKAHFFDPETEKVVEN

SEQ ID NO: 111 - DNA, 834 bp, Lactobacillus acidophilus
  CDS (1)...(834)
  misc_feature (0)...(0): Orf 1440; Multiple Sugar-Binding Transport System Permease Protein
atgatggagaaagaaaataaatcaaagaaattttggaattacgctttattaattgtaggcggaatcctcatattaattcccttactttatacatttttaagttcatttaagacaactaagcaaattatggaacatttctttgcttggcctaatccttggacaacagcaaactttaagaggttatttgctgacggagtaatgaattacttcggtaattcaattatcatcacagttctttcaattgttttagtaatgatcttcgtaccaatggctgcgtatgctattgcaagaaatatgtctaaaaggacagctttcaactggatgtacattctattaattataggtatctttgttccattccaagttatcatgattcctattacagttatgatgagtaaaatcggcctagctaatatgtgggggttgatcatcctgtacttaacatatgcggtaccacagacattgttcttatacgttagctacattaagcaaagtgtgcctgatagtttggatgaagctgcagaaattgacggtgctaataagattaccacttattttaaaattatcttcccattattaaaaccaatgcatgccacaactttaattattaatgcaatgtggttctggaacgatttcatgcttccattattgattttgaacaaagactcaaagatgtggactttaccattattccaatacaactacacaggtcaatacttcaatgactatggtccaagtttcgcatcatacgtaatcggtattatcactatcacaattgtatatttgatcttccaaaagaatattattgctggtatgagtaacggtgctgttaag

SEQ ID NO: 112 - protein, 278 aa, Lactobacillus acidophilus
MMEKENKSKKFWNYALLIVGGILILIPLLYTFLSSFKTTKQIMEHFFAWPNPWTTANFKRLFADGVMNYFGNSIIITVLSIVLVMIFVPMAAYAIARNMSKRTAFNWMYILLIIGIFVPFQVIMIPITVMMSKIGLANMWGLIILYLTYAVPQTLFLYVSYIKQSVPDSLDEAAEIDGANKITTYFKIIFPLLKPMHATTLIINAMWFWNDFMLPLLILNKDSKMWTLPLFQYNYTGQYFNDYGPSFASYVIGIITITIVYLIFQKNIIAGMSNGAVK

SEQ ID NO: 113 - DNA, 873 bp, Lactobacillus acidophilus
  CDS (1)...(873)
  misc_feature (0)...(0): ORF 1441; Multiple Sugar-Binding Transport System Permease Protein
atgaaatcaaagaattttattgaaaaatattggggctggctattcctaattgttccaattattttacaaatcgtatttttctatttcccattagttcaaggtgctttttacagttttactaattggacaggattaacttataattacaaatttgttggtttgaataactataaattattattcatggatcaaaactttgcaaaatcgattggctttacgatcattttgacactgtcgctaattataggtgaaattgcgattggtattttagtcgcaagagctttaaatgccaaaatcaaaggtagaactttctttagggcttggtttttcttcccagctgttttatcaggattaactgttgctttgatcttcaagcaagtatttaactatggcttaccagcaattggtaatgcattacacattagttggcttcaaactagtttgcttggtactgatataggtgcagttattgccacaatctttgttcttttatggcaaggtgttgctatgccaatcattatcttcttggcaggtcttcaaagtattccagatgaaattaaggaagctgcagaagtagatggtgctaataatcgtcaaattttctggaagattgaactcccttacatgttaccaagtatttcaatggtatttatcttggctcttaagtcaggcttaacagcatttgaccaaatcttcgccatgactagtggtgggcctaacaattcaactacatcattaggtttgcttgtttataattatgcatttaacaataactcatttggttatgctaatgcgatcgcaattgtattgttcttattaattgcaattatttcgttcattcaaattaagatttcaaataagtatgctgttgat

SEQ ID NO: 114 - protein, 291 aa, Lactobacillus acidophilus
MKSKNFIEKYWGWLFLIVPIILQIVFFYFPLVQGAFYSFTNWTGLTYNYKFVGLNNYKLLFMDQNFAKSIGFTIILTLSLIIGEIAIGILVARALNAKIKGRTFFRAWFFFPAVLSGLTVALIFKQVFNYGLPAIGNALHISWLQTSLLGTDIGAVIATIFVLLWQGVAMPIIIFLAGLQSIPDEIKEAAEVDGANNRQIFWKIELPYMLPSISMVFILALKSGLTAFDQIFAMTSGGPNNSTTSLGLLVYNYAFNNNSFGYANAIAIVLFLLIAIISFIQIKISNKYAVD

SEQ ID NO: 115 - DNA, 1269 bp, Lactobacillus acidophilus
  CDS (1)...(1269)
  misc_feature (0)...(0): ORF 1442 Multiple Sugar-Binding Protein Precursor
ttgaggagtgatcttatgaagagatggctgaaaaatataactctaattggagtcatgatggctacagtgataagtttatcagcttgtggtgataagcaaaatagtagctcaggcaaaaaagttactattgagtattttaatcaaaagaaggagatggcaggtactttaaaggaaattattaaagatttcgaaaaaaagaatcctgacattcatgtaaaagaagtcgatgtaccaactgctggtacagtgttgaaaactagaattctatcaggggatgtacctgatgtaatgaatatttatccgcaaaatatcgacttccaagaatgggccaaagctggatattttgaagatatgactaaggcgccatacataaagaacattaaaaataattatgcggattcatttaaagtaaacggcaaaatttatagtgcaccgcttagtgctaatgtttacggttttttctacaatgcgacagaatttgaaaagttaggtattaaaccacccaagacttgggatgaattcaagcaagtagttaagaaaataaaggctagtggaaaatcaccatttgctgtagcaggaactgaaccttggactttaaatggttaccatcaattatctttagcaactgtaaccggtggtgccaagcaagctaacaagttacttagatactcagctccaaacggaattaaggtaaataatccttatattcaaaaagattttactcgtttgaatttacttcgtgaaaatgcacaaaataactggcgtggtgctagttacaacgatgctgttgtttcatttgctactggtaagagtttgattatgccaaacggttcatgggctttgccactgattaaccaacaaaaacctaaatttaaggtaagaaccttcgcattcccagctgcaaaggcaggacatgaaatgaccgtcggttctggtgatcttgcgttgtcaatctcttctaagagtaaacataaaaaggctgccgaaaagtttgttgcctacatgactacaccagctgcaatgcaaaaatactacaacgtagatggtagtccagttgcagttaaaggagtaaagcaaaaaggagttgactctcaattaggtggtttatcaagcttagcatttactaagcacgacatggtttggttggcacaagactggacaagtgaaaatgatttcttcaacttaactgccagttacttgatgacaggtaataaacaacaaatggttaatgatatgaatactttctttaacccaatgaaggctgctgac

SEQ ID NO: 116 - protein, 423 aa, Lactobacillus acidophilus
MRSDLMKRWLKNITLIGVMMATVISLSACGDKQNSSSGKKVTIEYFNQKKEMAGTLKEIIKDFEKKNPDIHVKEVDVPTAGTVLKTRILSGDVPDVMNIYPQNIDFQEWAKAGYFEDMTKAPYIKNIKNNYADSFKVNGKIYSAPLSANVYGFFYNATEFEKLGIKPPKTWDEFKQVVKKIKASGKSPFAVAGTEPWTLNGYHQLSLATVTGGAKQANKLLRYSAPNGIKVNNPYIQKDFTRLNLLRENAQNNWRGASYNDAVVSFATGKSLIMPNGSWALPLINQQKPKFKVRTFAFPAAKAGHEMTVGSGDLALSISSKSKHKKAAEKFVAYMTTPAAMQKYYNVDGSPVAVKGVKQKGVDSQLGGLSSLAFTKHDMVWLAQDWTSENDFFNLTASYLMTGNKQQMVNDMNTFFNPMKAAD

SEQ ID NO: 117 - DNA, 837 bp, Lactobacillus acidophilus
  CDS (1)...(837)
  misc_feature (0)...(0): ORF 1443; probable transcription regulator msmR
atggaaggcgaatatagagcattaaatgatattagcttagaaagcaacgttctattttttggaaaagaaagttgtttaccgaattatttctatccgggcaataacgttagaaaaaattatgttattcactacattctaaaaggaaaaggcactttctcatctgccaaccatccttcaattgaactaaaagctggtgacatatttattttgcctaaagggataccttgtttttataaagcagatggtaaagagccttggacctatctttggattggattttcaggattaaaaattaaaaacattttatcaagatctcttctactctctcagcgttacttgcatcaagtacaaaattcacacttcactgatagcttattaaaactttttgatgcattacacaatccagatacttctactaataatgatcttttaattgaatcacttatctatcaaactttttattacttaaattcagaatatcctgctcaaaataaaactaatattaaaagctcaattcgattaaaaactgctacaaaatatttgtatgataattttactgataataattgctcaatctatttattatgtaacaaactaggtgtttccagaagttatttatataacatctttaaagaagggatgaacttatcaccacaacagtttttaattaaactgcgaatggaagaagcaaaaaacaagttaaaaaatagtcaaaattctattcaagaaatttcaacttcagttggctatacagatacttttactttttcaaaagcctttaaaaaatattcaggatttagtcctaaaaattatcgtcaaataaaaagcagtgaaaat

SEQ ID NO: 118 - protein, 279 aa, Lactobacillus acidophilus
MEGEYRALNDISLESNVLFFGKESCLPNYFYPGNNVRKNYVIHYILKGKGTFSSANHPSIELKAGDIFILPKGIPCFYKADGKEPWTYLWIGFSGLKIKNILSRSLLLSQRYLHQVQNSHFTDSLLKLFDALHNPDTSTNNDLLIESLIYQTFYYLNSEYPAQNKTNIKSSIRLKTATKYLYDNFTDNNCSIYLLCNKLGVSRSYLYNIFKEGMNLSPQQFLIKLRMEEAKNKLKNSQNSIQEISTSVGYTDTFTFSKAFKKYSGFSPKNYRQIKSSEN

SEQ ID NO: 119 - DNA, 462 bp, Lactobacillus acidophilus
  CDS (1)...(462)
  misc_feature (0)...(0): ORF 73
ttgagtatgaaacttagcaaaaaattgttgttttcttccgctgttattgcgggacttcttttaagcgttgcacctgctactgttcaagctgcaaaacaattgccagtacatgactataataggatcacttctgcgtacatcactttccctaaggatacagatgtttacaatgcagatggaaccattcaagatcataatggtcaaaagataagcagacaaaaaggctggttaaaggtagacaagttggtttatatttgggtaccaagtgaaaataaggctgaattattctatcacttggtaggtacgagtttttacgcaagcacaacaccaactgctcgtaagagcaggattgaggtgggtcataatgcttatgtaaaagctaacgatgtcaaagccattgacgtaggtttgaaattaaccccatcaaatacagccgctgaagcagaagctgctgcgaaaaag

SEQ ID NO: 120 - protein, 154 aa, Lactobacillus acidophilus
MSMKLSKKLLFSSAVIAGLLLSVAPATVQAAKQLPVHDYNRITSAYITFPKDTDVYNADGTIQDHNGQKISRQKGWLKVDKLVYIWVPSENKAELFYHLVGTSFYASTTPTARKSRIEVGHNAYVKANDVKAIDVGLKLTPSNTAAEAEAAAKK

SEQ ID NO: 121 - DNA, 1590 bp, Lactobacillus acidophilus
  CDS (1)...(1590)
  misc_feature (0)...(0): ORF 74  abc transporter bacteriocin
atgaacttaaaagatctatttaaaactaacaagcttagatttatcgctatttgccttttagtagcaattgaaattttatgtgctaccagtgtaacttattttatgacgccagcttttaattatattaagcagaataaattaaatatatttttaatttttattattttctcagctgctttgcaattactagatacaattttgcaatctattaatatggttctctataatcaacaagttcaggactatattcacaatattagaaataatattagtagatatttttttcataagagcgaagaaaaagtcgcagaaattcaaaatgatttagatacaaatatgcaggagctgacttctaagtacactactcctttattagttctaggcaggagaatattaacaatcctattctctattggagtattatttacattcaattggagtttagtagttttaacattattgttatcttttattggtttatatctacccaaaatatttgaaaaagttacttcctcagctacctttgaagttactaagaagaatgaacaattacttaatacaattggaaaatgggctcaaggtttaagtgaattaaggcgatacgcgagtttaaaaagctataaaaaagctattcaaaattctacttctgaattaaaaaatgctactatcaaagattgttattggggtaattgggcaacagctgcaacttcatttgtttctcttttaggaatagcattattgctttttctttcaatatacttgtatgcaacaggtcaaatcgtctttggtgcggtaattacttctggaatctttgctaatcagatcatgaattcagttacttatttggcagatagtattaaccagattaaatcttccaaaaagctaagacaagaaattagtaaattgcaacaaccagtagaatttacagttccagacaattctgctcaaaatattgctcatattgaagtatcagatctacaagtttcatttaagaatggagaaaatatttcttatcctcatattcaaattaataaaggcgaaaaagtactgcttagtggtgatagtggtgtaggcaaaacaacgctatttaaagttttattaggtcaaattaaacccaaaagaggtcagattatttataagaatgagcagggccaatcttttatgccagatttagagcgcattggctatattgcacaagataatacattatttcctgatactattgaaaataatattacgatgtttgatacaaaattaactggaaaagttacagaagcaattaaaaaggttaaattagataaagatatcaaaaagtttccagctggagtaaaaacaatggttgatttagatcatggaaacatatcgggtgggcaaaagcaaaagatagttttagctagagctgatattcataacagtgatttattattaatcgatgaaggtactagtgcgatcgacagtaaggctactaaagaaatattaaaggaaattcttaaatcagatcgaacgattattatgattgcacataatctttctcaagagatgattgcaatgtttgattacaaaattgatttgagaaagatggaggtaaac

SEQ ID NO: 122 - protein, 530 aa, Lactobacillus acidophilus
MNLKDLFKTNKLRFIAICLLVAIEILCATSVTYFMTPAFNYIKQNKLNIFLIFIIFSAALQLLDTILQSINMVLYNQQVQDYIHNIRNNISRYFFHKSEEKVAEIQNDLDTNMQELTSKYTTPLLVLGRRILTILFSIGVLFTFNWSLVVLTLLLSFIGLYLPKIFEKVTSSATFEVTKKNEQLLNTIGKWAQGLSELRRYASLKSYKKAIQNSTSELKNATIKDCYWGNWATAATSFVSLLGIALLLFLSIYLYATGQIVFGAVITSGIFANQIMNSVTYLADSINQIKSSKKLRQEISKLQQPVEFTVPDNSAQNIAHIEVSDLQVSFKNGENISYPHIQINKGEKVLLSGDSGVGKTTLFKVLLGQIKPKRGQIIYKNEQGQSFMPDLERIGYIAQDNTLFPDTIENNITMFDTKLTGKVTEAIKKVKLDKDIKKFPAGVKTMVDLDHGNISGGQKQKIVLARADIHNSDLLLIDEGTSAIDSKATKEILKEILKSDRTIIMIAHNLSQEMIAMFDYKIDLRKMEVN

SEQ ID NO: 123 - DNA, 1590 bp, Lactobacillus acidophilus
  CDS (1)...(1590)
  misc_feature (0)...(0): ORF 74  abc transporter bacteriocin
atgtcttttaagggtttcgttacgacaaatagattgcgtttcttcttcatcacttttttatctattttgtctggagtaagtgggattttggctggttatattcaaatgtattggttaacgtacattaagaataaggcatggctagaagtgggaattactaccggtttaatgatactttgttggttctttgcccaatctatgatttattttgtgcaatatttgaataatgtgcaagaagaagaatattttaaacagcttcgtgatcaaatagctgatcattattttaaagatggcaaatttcataaagtttctgcgtttcaaaataggttaaccaatgattttttgattgtaaaaaataatttttttgaatggtatgtgattgtgcctttctatgggtcaatgctaatagcttctttaattgctttgctaacaattcattggttaatttttattttgagcttaataattgatgctatttcatatttcttgcctaaattaattgataaaaagctggaacaggcaacaattaatgtttcagatagaaataaggattatctgaatgtaataagccaatggttctctggtttaagtgaactaaaaagatatctagctggtaataaattgttgaaggtccaaagtaatgcttcacatgaattggaaaaagcaaatgtgaagcaaattactatgcagcaaatattaagtattttaaacggaattggtgcattgctttcgacaattattttattaggcgtaacaggtcttctagtagagcaaaaactagttatttttggtgctattttgtcagttcaaaattttgctaataatgtcgcatttgggatgcaagaaactattgaaggactaacgatgatgcgatcagctaaacctttaatgatggatattagtcgagatgctgctgagattgcaatgttggataactcaaatacagaagttccgtttttaattcaaactaaaaacttggctttagctttccctaatggcgaaactttgcaatatccagatattaccgttaaacaaggcgaaaaaatactagtaactggtgattccggctcaggtaaaactacgttgtttaaattactattggggataattaggccaagtcaaggtaaagtcgagtttaaggataaaaataatcatagtattaaaccagatatgtcaaagattggttatattccgcaggatccaaatctgtttccaggtactataaagcaaaatattacgatgtttaatgataaattgaacaataatataactgctattttaaaggatgttgatttggatagtgatatcaaaaaatttaaaagtggtatcgatacagaattgaatttggataaactaaatatttcaggtggacaacgacaaaagatagtacttgctagggtaaaaattcatgattgtaagataatcctaattgatgaagggacaagtgctgtcgataaaaaagggactttagatatcttacaaaatcttgtgcaaagtaaagatacaatcatatttattgctcacaactttaatgaaaagatgtgtagcctgtttgatcgaaaaattgaactatataacacaagaggtaaa

SEQ ID NO: 124 - protein, 530 aa, Lactobacillus acidophilus
MSFKGFVTTNRLRFFFITFLSILSGVSGILAGYIQMYWLTYIKNKAWLEVGITTGLMILCWFFAQSMIYFVQYLNNVQEEEYFKQLRDQIADHYFKDGKFHKVSAFQNRLTNDFLIVKNNFFEWYVIVPFYGSMLIASLIALLTIHWLIFILSLIIDAISYFLPKLIDKKLEQATINVSDRNKDYLNVISQWFSGLSELKRYLAGNKLLKVQSNASHELEKANVKQITMQQILSILNGIGALLSTIILLGVTGLLVEQKLVIFGAILSVQNFANNVAFGMQETIEGLTMMRSAKPLMMDISRDAAEIAMLDNSNTEVPFLIQTKNLALAFPNGETLQYPDITVKQGEKILVTGDSGSGKTTLFKLLLGIIRPSQGKVEFKDKNNHSIKPDMSKIGYIPQDPNLFPGTIKQNITMFNDKLNNNITAILKDVDLDSDIKKFKSGIDTELNLDKLNISGGQRQKIVLARVKIHDCKIILIDEGTSAVDKKGTLDILQNLVQSKDTIIFIAHNFNEKMCSLFDRKIELYNTRGK

SEQ ID NO: 125 - DNA, 1581 bp, Lactobacillus acidophilus
  CDS (1)...(1581)
  misc_feature (0)...(0): ORF 1131  ABC transporter
atgaatttaaagcaatttgtttatattcatccctttagatttgctttatttgtcttaggatcaatagtagtacctgctatggctatttttagtacctacttgactcaaaccttaacaaatatcctactggcaagaaattggcatgattttatcttgctagctattatatgctttttcatcatgcttattttgaacttcctaataccaatagtgcaaaatactgataattatttacaacaagatctaaatcaacaagttagagctaagatagttaagcactattatgatgatcaaaagcaacattctgttgcagatatgcaaaaccgattaactaatgatctaacacttattaatgaaaattactttgacaatttattcggtgtgatttatggtaccgtcttgattattagtgtattaatttatttgattctgttaagttggcagttattaatcgtgatttgcataatggtagctgtatcattgcttctacctagattaacagaaaaaccattacaaaaagccaatcaaatgatctctgatagtaatcaagtttatctagatacattaaatgattggttatcaggcttagaacagattagacaatttttggctggtgctaagttattctcagttactgcaaatgcttcaaagaaattagaagatgccaacgtcgagcaaactagctatattaaattgcttgaagctgttaatgggatcgtttcagcattgttcggcttaatactattcattctagctggagttttggttaaacaaggtactataactattggtgctttaataattgtaggaaacttccgcttttaccttaatcaaggtattaatttggttacatctggtcgtggtgcaatgaaaggtacgactaaattgattgaagaagttgatcagtcagcaagtagtgttatggtaccaaaagaaaagcaaggcgttgtacctgcttcaattgaaactcataatcttaaattgcagtttccaaatggtgagagcttagctttcccagacttgcaaattaagcaaggtgaaaagattttattaaccggtgattcaggtgctggtaaatctacattgtttaaattgattctgggagaattgaagcctagtgaaggtaatgtagtttataaagatcagaatggtaatgagattactcctgatttaagtaagattggttatataccacaagatccagtagttttcccagccacaattgaagataatattacaatgtttaacgatcagcttgatagcaaagttaaagccgcggttaaagaagttaattttgatacagatattgataaattcaaggatggtttaaatgaaaagttagatttggataagttaaatatctcaggtggtcaaagacagaagattgttttagctaaagctaaagtgcatgacagtgacattattctgattgatgaaggtactagtgccattgatcagaatgctacaatggatatattgaagaatttggttaatagtaaggcaacgattgtctttatcgcacacaacttcaatgaagggatgcacaagttgtttgatcgtgaaattcatttggtaaaggaa

SEQ ID NO: 126 - protein, 527 aa, Lactobacillus acidophilus
MNLKQFVYIHPFRFALFVLGSIVVPAMAIFSTYLTQTLTNILLARNWHDFILLAIICFFIMLILNFLIPIVQNTDNYLQQDLNQQVRAKIVKHYYDDQKQHSVADMQNRLTNDLTLINENYFDNLFGVIYGTVLIISVLIYLILLSWQLLIVICIMVAVSLLLPRLTEKPLQKANQMISDSNQVYLDTLNDWLSGLEQIRQFLAGAKLFSVTANASKKLEDANVEQTSYIKLLEAVNGIVSALFGLILFILAGVLVKQGTITIGALIIVGNFRFYLNQGINLVTSGRGAMKGTTKLIEEVDQSASSVMVPKEKQGVVPASIETHNLKLQFPNGESLAFPDLQIKQGEKILLTGDSGAGKSTLFKLILGELKPSEGNVVYKDQNGNEITPDLSKIGYIPQDPVVFPATIEDNITMFNDQLDSKVKAAVKEVNFDTDIDKFKDGLNEKLDLDKLNISGGQRQKIVLAKAKVHDSDIILIDEGTSAIDQNATMDILKNLVNSKATIVFIAHNFNEGMHKLFDREIHLVKE

SEQ ID NO: 127 - DNA, 1602 bp, Lactobacillus acidophilus
  CDS (1)...(1602)
  misc_feature (0)...(0): ORF 1132  ABC transporter
ttggaggaaaagcctatgacaataagagagctttttaaaagtaatataccgcgttcaatcttaatcattacgctttacgtgttatatgcattttctggtagtttttcgcagtactttcttaaatatgctttaaacggaattactgcaggaaaactagatacatatatttattggcaatttattcaagcaggactagaaattattactgccttgcttctgccaattgcaactgtggtttttaccagacaaacgcaagattatttacatatgattaggaaagacattatgcaccattactatggtgaaggggatgctaagcttgctgatatgcagaatgaactaactgccaatcttaagttacttacaacaaactatgcagccacttgggtcactattttaagtggtatcttggaaattaccattgcaattgctttgttgataagcatgaactggattttgattgtaactacagcaatcttagccgctattactttatctttacctaagataatggagaaaaagacctctataacaatggataaggtaaaccaagagcacagtaaattgctgaatgcgattgaacattggttgggtggtctccaagaattacgtcgttatactgcttatggcagattagctagacaaatgcagaaagttagtggcaattatgttaaggcaaataagcaaaactataaataccgggcaatttctgaaattatcaatggattgggtaatgctttatcacaaatagggatgtcagtcgtggctggtatattattcttgatgcatattatttcatttggtgattttgcggttgctagcagttttgcttttactattttctcaggtatttgggatatcaccaatgctttaaccaaggtgaagtcaactaaggcattacgtgaacaaaccgctgagttacgtaaagccaaaggtatttctaagaaaacagatgcctatggtgttgctgtatctgggttaaaagccaagtataaagaaggagaagagatttcttaccctgactttacaatcaagaaagggcaaaaagttctattggttggtgactcaggtacaggtaaatcttctttgtttaggatgttgctaggtaagcttaagcctgaagctgggcagataactttctttgatcagaacggtcaagctatttctttggataaagcaaaagttggatacttacctcaagatccagttgtctttcctgcaagtattaaagataatatcgtgatgtttaatgataaactgacaaacaagatagctgaagttactcagtcagttcaattacggcctgatttagctaaaatgccagcgggaattgatactgaaatagatttaaagaaagagaatctatcaggtggtcaaagacaaaaggtcgtactagctagaagtgaaattcatgaacagccatttgtcttaatggacgaggtaactagtgctattgaccaaactacaactgaagaaattattgataaactccttcaaacagaccaaacaatcttattaattgcacataactttaccccagaattacaggcaaaatttgatcagataattcaattgaagagtaagaaaggagcagcagaaaaa

SEQ ID NO: 128 - protein, 534 aa, Lactobacillus acidophilus
MEEKPMTIRELFKSNIPRSILIITLYVLYAFSGSFSQYFLKYALNGITAGKLDTYIYWQFIQAGLEIITALLLPIATVVFTRQTQDYLHMIRKDIMHHYYGEGDAKLADMQNELTANLKLLTTNYAATWVTILSGILEITIAIALLISMNWILIVTTAILAAITLSLPKIMEKKTSITMDKVNQEHSKLLNAIEHWLGGLQELRRYTAYGRLARQMQKVSGNYVKANKQNYKYRAISEIINGLGNALSQIGMSVVAGILFLMHIISFGDFAVASSFAFTIFSGIWDITNALTKVKSTKALREQTAELRKAKGISKKTDAYGVAVSGLKAKYKEGEEISYPDFTIKKGQKVLLVGDSGTGKSSLFRMLLGKLKPEAGQITFFDQNGQAISLDKAKVGYLPQDPVVFPASIKDNIVMFNDKLTNKIAEVTQSVQLRPDLAKMPAGIDTEIDLKKENLSGGQRQKVVLARSEIHEQPFVLMDEVTSAIDQTTTEEIIDKLLQTDQTILLIAHNFTPELQAKFDQIIQLKSKKGAAEK

SEQ ID NO: 129 - DNA, 1581 bp, Lactobacillus acidophilus
  CDS (1)...(1581)
  misc_feature (0)...(0): ORF 1357  ABC transporter
atgagttggaaagaattatttaaattaaatccttggcattttagtgtggctcttttattgcaaatgataggtgcaggatttgaaataggggtagcttactttttaactttgcaatttaatgcagtacgtggtcataatttacagatgtttatattttggactagcctgcaagtaatttgttatgtgattttatatctttcctataatattgctgggatcatgtggcaaaagcatattcaaaattatttacacttaattagacaagagataacagatcattactttgaagatggtaagagtcaccatacaggtaatgtacaaagtagaatgactaacgatttaaccttacttcataatgattatttaaattcgtttcgttatattgcagggatgttagttagtgtatttagtgtggcgttgatgctctttacatttcaatggagtttattggtagcttgtgtagtcttggcagcagtccaaatatgtttacccaaattaatagacaagcagttaagaaaaactactaatttggtatctgatgctaataagaagtatttgaaaacactgggtgattggcttattggtttgtcagaattacgtagatatttggctggggaaaaattatttaaagtaattgctaaagattcaggacgattagaaaatgccaatatccaaaaacaaaaggtggatcaaaagctagattatttaaatcaattggcctattcagttggggatgcattgattttcttattgacgggttttttagtagttaataattgggctgcttttggtttaattgccagtattggtaactttagttcagctatgtttgtttcacttcaaggaatcgctaattatggtggacgaatgaaagcaactaaggaattacgagaaaagatcctgcaagccagaaaaaagattaataatgaaagagatcataattttaagcaaccggttgctttttcaactaaaaatttagcaattaaatttgagaatggtgaagaagttgcctttcctgatattcaggtcaatgctggtgaaaaaattctgcttacaggtgatagtggaacaggaaagagtactttgtttaagctgattttaggagaagaaacggcaacaagtggtaagattcaatattttgattcaaatggcaaacttatccaacccgatttagccgaaatagggtatttaccacagactcctgtgcttttccctgctacgattgcggaaaatataacgatgtttaatgagaagttaaagcggttggttaaccaaacagtggaagaagtacagctggtgagtgatataacgaaatttcctaatgggattgagacgaaaattgatttaaatcaacttaatatttcaggaggccagcgtcagaagattgttcttgctagaagtaaggttcatcaaagcaaattaatcttaattgacgagggaacaagtgcgattgatcaagctgcaacaatgaaaattttgaaaaaactagttaaaacagatgcgacaattgtttttattgcacacaattttaatgaagaaatgcaacagatttttgatcgtgagatttatttgaataataga

SEQ ID NO: 130 - protein, 527 aa, Lactobacillus acidophilus
MSWKELFKLNPWHFSVALLLQMIGAGFEIGVAYFLTLQFNAVRGHNLQMFIFWTSLQVICYVILYLSYNIAGIMWQKHIQNYLHLIRQEITDHYFEDGKSHHTGNVQSRMTNDLTLLHNDYLNSFRYIAGMLVSVFSVALMLFTFQWSLLVACVVLAAVQICLPKLIDKQLRKTTNLVSDANKKYLKTLGDWLIGLSELRRYLAGEKLFKVIAKDSGRLENANIQKQKVDQKLDYLNQLAYSVGDALIFLLTGFLVVNNWAAFGLIASIGNFSSAMFVSLQGIANYGGRMKATKELREKILQARKKINNERDHNFKQPVAFSTKNLAIKFENGEEVAFPDIQVNAGEKILLTGDSGTGKSTLFKLILGEETATSGKIQYFDSNGKLIQPDLAEIGYLPQTPVLFPATIAENITMFNEKLKRLVNQTVEEVQLVSDITKFPNGIETKIDLNQLNISGGQRQKIVLARSKVHQSKLILIDEGTSAIDQAATMKILKKLVKTDATIVFIAHNFNEEMQQIFDREIYLNNR

SEQ ID NO: 131 - DNA, 1587 bp, Lactobacillus acidophilus
  CDS (1)...(1587)
  misc_feature (0)...(0): ORF 1358  ABC transporter
atgaggaaaataatgggtttaaaagattatctcaaaacaaactatcagcgtgcatttttagtactgtttttaatcacgcttacacaggctgcaactacgctttatacttacttaactagtccagaacttgatgcaatttcacaaggaaaatttattttatttattgaaataatcgcgggtcaattcataattggacagatttgtaattcaagttttaatattgccagcgtgcaaaataccaaacaaacgcaaaatttattccatcaagttcgccaaaatatggttagacattattatcaaaagcctgcccaagtagctgaaatggaaaatcatttgggtaatgatttacaaactattcaatcaagttactatgatatttatttttattttgcgtgtgatttaatttatgtcttttttacaattggtactttatttacctttcattggttacttgtggcatatagtcttttaattacttttttggctattgttgttccaaaattgttagaaaaatatacaaatagagctactgagaaagtttctgaaaagaatgctcaatttttaaacttaattgaaaattggttcaatggtcttgaagaacttagaagatataagaataaaaatatcttgaaaaagaaaattagcgaatcaagtcgtcagcttgaacaaagtgaatttcagcgtgataagacattaatttatgttgaaatggttgcagccatttttgatgttatgggtcgagttggcgtaccggtgcttgcaggagttttgtttttcaatcatcaagtaagcttgggggcaattttaactgctggctattttgctaatggaattttttatagcgtgaatagttgtgtaaccaagtatgctcagcttaaatcaacgagtactttaagaaatcatctggccgaattacaaaaacttaatgctgatgaaaaatttgattcaattgctgaaattgatagggtcgaagtgaaaaatttagcaattcaatatgagcatggagaaaaaattacttatcctaattttgtaattaagcgcggcgaaaaagtattacttacaggcgatagtggcactggtaagtctactttattaaaaacaatgctgggccaaattcaaccaataactggtgaagtgctatataaagataaaacgggaaaaattattcatccagatttgaatcaaattggctatttagcgcaggatttaactatgtttgatgcgactattttggaaaatattacgatgtttaatgcccaattaaaagatcaggttaaagacgtagttagaaataatatttttgccaaagatgaaaaacgctttaaagatggattggctactgagattgaagtgaaacatgatcttctttcaggggggcaacgacagaaggttgttttaatgcgggcgctgatccataaaaaaccgattttgtatttagatgaagctactagtgcaattgatcaagcagcgacaacaaggattttgcaaaatttagtgcagacggatagaactattttgatgattgctcataatttgactaaagagcaaaaagcattattcgatcgtaaaatttacttggagggcaaa

SEQ ID NO: 132 - protein, 529 aa, Lactobacillus acidophilus
MRKIMGLKDYLKTNYQRAFLVLFLITLTQAATTLYTYLTSPELDAISQGKFILFIEIIAGQFIIGQICNSSFNIASVQNTKQTQNLFHQVRQNMVRHYYQKPAQVAEMENHLGNDLQTIQSSYYDIYFYFACDLIYVFFTIGTLFTFHWLLVAYSLLITFLAIVVPKLLEKYTNRATEKVSEKNAQFLNLIENWFNGLEELRRYKNKNILKKKISESSRQLEQSEFQRDKTLIYVEMVAAIFDVMGRVGVPVLAGVLFFNHQVSLGAILTAGYFANGIFYSVNSCVTKYAQLKSTSTLRNHLAELQKLNADEKFDSIAEIDRVEVKNLAIQYEHGEKITYPNFVIKRGEKVLLTGDSGTGKSTLLKTMLGQIQPITGEVLYKDKTGKIIHPDLNQIGYLAQDLTMFDATILENITMFNAQLKDQVKDVVRNNIFAKDEKRFKDGLATEIEVKHDLLSGGQRQKVVLMRALIHKKPILYLDEATSAIDQAATTRILQNLVQTDRTILMIAHNLTKEQKALFDRKIYLEGK

SEQ ID NO: 133 - DNA, 1800 bp, Lactobacillus acidophilus
  CDS (1)...(1800)
  misc_feature (0)...(0): ORF 1679  permease
atgatttggaaattatctttaaccgggattaaaagccggctaaaagactataccgtcctattttcaggattggttgtagctagcatgattttttacatgttcttgtctttagctattaatccaggttttatgagtaaggatgttaacgcaccaggtcaatacctgagttttatctttggctttgggatcgtcttattagcaattattacatttatttatttggtttatgcaaattcatttttattgagtatgcggcaacatgattatggaatgttcatgatgctaggagcaaaaagttccagaataggcttattaatcttctgtgaaactctacttactggacttattgctacaatacttggaatttttattggttttggcttaactgcccttatttcaaaattgttgattagtaatcttggtcttaaaattactcattttcaagtaattttaccagctgcaattatttggacgttaattttctttattgctgtctttttcttagcagcattaagaaatgttcataagcttgtccgcagtaaggtgattgaccttcttcacgaaaatcaaaaaccaattaaaattagtcgtaaaaatggtttaaaaatagctgaggctattttaggtattgcgttgttagctgctggttattacattatgggtatgccagcaagtgctattttcttcattattccagctgctttaattactattgtggcaggtacatatttcacattcaattcattattcactctcattattaatttcttacttaaaagaaagaactatgcatattgcggcattcgcgtctttactttaggtcaattaaagttcagaatctgggattacacgcgtattctttcagttatctcactacttttcgcattggcacttggtgcaattactgttggtcttaactttaattcattaaaagagcaggcaataaatagcacttactatgatgctacaattgttaaaaacactgcagatactatgaagaatgtagctaaattagatcttaaaactaaatcaacttatcactatgttgaaactaaaaaagacgtttactttgatagaagtgaatttgaaaaagctccattaaaagacattaagtttaagcaaaatggcaataacttccctacatacaagccaattactcttaaggttagcgatttaactaaaaaagacagctatgctgctatgattttagggatgcaaactaatactgccaaaaagacaatcaagctggtttcttcagataaattaaatagtattcaagggcaaaagaaatttattacttttattaccgtaaaaaattttgtcaaagattatccgactttgatgaagatcgagaagaatcaactcaaggttgctccagaaatggcagaatcattacaatcgaccaaaccattctcctaccaaatgatacttggatttgtcagtgggttcgaatttatgggctttttcctcggaatcgcctttctcaccatgctcgcttcaacattgatgttcaaagtattaagcggcgccgccagcgacaagctgcgttacgagatgctttataagattggcactagaagaacagtgcttaagaagtcaattagaaatgaaattggtgtattattccttatccctggtattttaggagtagtggatgtattatttggtcttcgcttatttacagcattgttaccacatccatatatgggcttttggttaccattcttaatcttcattgtcctttactttatttactatattgtgactgtaaaactttacgaaaatattgttttaaataaa

SEQ ID NO: 134 - protein, 600 aa, Lactobacillus acidophilus
MIWKLSLTGIKSRLKDYTVLFSGLVVASMIFYMFLSLAINPGFMSKDVNAPGQYLSFIFGFGIVLLAIITFIYLVYANSFLLSMRQHDYGMFMMLGAKSSRIGLLIFCETLLTGLIATILGIFIGFGLTALISKLLISNLGLKITHFQVILPAAIIWTLIFFIAVFFLAALRNVHKLVRSKVIDLLHENQKPIKISRKNGLKIAEAILGIALLAAGYYIMGMPASAIFFIIPAALITIVAGTYFTFNSLFTLIINFLLKRKNYAYCGIRVFTLGQLKFRIWDYTRILSVISLLFALALGAITVGLNFNSLKEQAINSTYYDATIVKNTADTMKNVAKLDLKTKSTYHYVETKKDVYFDRSEFEKAPLKDIKFKQNGNNFPTYKPITLKVSDLTKKDSYAAMILGMQTNTAKKTIKLVSSDKLNSIQGQKKFITFITVKNFVKDYPTLMKIEKNQLKVAPEMAESLQSTKPFSYQMILGFVSGFEFMGFFLGIAFLTMLASTLMFKVLSGAASDKLRYEMLYKIGTRRTVLKKSIRNEIGVLFLIPGILGVVDVLFGLRLFTALLPHPYMGFWLPFLIFIVLYFIYYIVTVKLYENIVLNK

SEQ ID NO: 135 - DNA, 747 bp, Lactobacillus acidophilus
  CDS (1)...(747)
  misc_feature (0)...(0): ORF 1680  transporter
atgaatgaaattcttatggtggataacatcactaaaacttacggtaaaaaaggtgaaaaacaataccaagctttgaaaggcgttaactttaaagtagcttctggtgaatttgtcgcaattatgggtgcatctggttcaggtaaaactacattgcttaacattctttcaacgttagataagcctacaaccggtcaagtctgtattaacggtaaagatattagtaatttaaatgctaatcaaatggcagattttcgtagtaaagaaataggttttattttccaagattttaatttactagaaaatttgaccaatcgtgaaaacattgctttaccacttagtttgcgcggtatttcgactaatcgaattaatccacttgtggataagattgctgaaaaattaagtattgcagaaatactaagcaagtatccagcagaaatttcaggtggtcaaaaacagcgtgttgcatcagctcgtgcattggtacatgagccagcaatgcttttggccgatgaaccaactggtgcacttgattctaagagtgctagagaattattaaatacaatggaaaacttaaataagcgagatggtgtaactactttgatggttactcacgatccattttccgctagttttgctaatcgaattttatttattaaagacggtaaaattggtgaacaaatggttaaaggggataaatctagaacggacttttatcatgaattaattgctcacttaggtactgaagaa

SEQ ID NO: 136 - protein, 249 aa, Lactobacillus acidophilus
MNEILMVDNITKTYGKKGEKQYQALKGVNFKVASGEFVAIMGASGSGKTTLLNILSTLDKPTTGQVCINGKDISNLNANQMADFRSKEIGFIFQDFNLLENLTNRENIALPLSLRGISTNRINPLVDKIAEKLSIAEILSKYPAEISGGQKQRVASARALVHEPAMLLADEPTGALDSKSARELLNTMENLNKRDGVTTLMVTHDPFSASFANRILFIKDGKIGEQMVKGDKSRTDFYHELIAHLGTEE

SEQ ID NO: 137 - DNA, 1269 bp, Lactobacillus acidophilus
  CDS (1)...(1269)
  misc_feature (0)...(0): ORF 1681
atgaaaaataaaaaaatttggattataggaattatcattgttttaataggcgcatttattggctggggtaatttttattatacgaaagatcgtcaaattagtcgtattataaataatctgcaagatcctaaggtggatatgtctaaaaatgtggttgcatcgacaccagatatggatataactagccaaagtttaaagccgctacagagttattttaaagaacatactaaggcagctaaacagcttaattataatttacgccataatcgtgataatggtgaaattaagttggtgcaagatggtagacactttttgttttttaccagatataaattatgggttcaatgctatcgcccacaaattcaaactaatcatgccaattcaagtttaaccattaatggcaaaaatctgggacaaatggaaggcggtaaccaaaattactaccaagatttaggcttagtttttccaggtcgttatcatgttttagttaaatctaaagtaaatggccgtaatctcgacgctgactcaattgttaacatttggtcaaacaagactgtaaatatgaatatcaagactgctactttccaggtacacagtgtacctaacggaattatatatgttaacgatcgtaaagtaggtaagcttaataagtatggtaattatacttttaaaaactacccaattgccaagcgaatggagatttatattgctacgaaggttgatggccagacagtcaaatctgaaaaagtaacagatttatcacaatcaattagtccagaatttagtagcagtgatgatgatgtggctgactatgatagtgctaatgcgaattatcaaggaaacgatgaaaaagatgtttaccaagacgtagaaggcgactatattgttaatccaatttggccaggtttaataaaggctcaagatgctgctaaacttctttatgataattttaaagaaccagacagtacgttatttgaaaatggaaaagaaaattcggattataagaagattgctgaacaggttaaaaaatggaaaaagaagaaggatttaaagaaatatagtgtagaagtaaaaataatttctgttctaccaggaaagcataattacagtaaagttaattacgaagtaacctttgtcaaaaaatataaagataaaagtaaaaagaaagaaaaattattgtaccaagacgctgtattacacttcgtaaataaaaaacagcaaattcaaactttaggaaagtgcaaattaataaaaattaaaactagtaat

SEQ ID NO: 138 - protein, 423 aa, Lactobacillus acidophilus
MKNKKIWIIGIIIVLIGAFIGWGNFYYTKDRQISRIINNLQDPKVDMSKNVVASTPDMDITSQSLKPLQSYFKEHTKAAKQLNYNLRHNRDNGEIKLVQDGRHFLFFTRYKLWVQCYRPQIQTNHANSSLTINGKNLGQMEGGNQNYYQDLGLVFPGRYHVLVKSKVNGRNLDADSIVNIWSNKTVNMNIKTATFQVHSVPNGIIYVNDRKVGKLNKYGNYTFKNYPIAKRMEIYIATKVDGQTVKSEKVTDLSQSISPEFSSSDDDVADYDSANANYQGNDEKDVYQDVEGDYIVNPIWPGLIKAQDAAKLLYDNFKEPDSTLFENGKENSDYKKIAEQVKKWKKKKDLKKYSVEVKIISVLPGKHNYSKVNYEVTFVKKYKDKSKKKEKLLYQDAVLHFVNKKQQIQTLGKCKLIKIKTSN

SEQ ID NO: 139 - DNA, 1314 bp, Lactobacillus acidophilus
  CDS (1)...(1314)
  misc_feature (0)...(0): ORF 1793
atgaataagaaaaatgtatcaatgctaatgttaagtccagcaatcttattaatgatgaatagtactattgtgcatgcggataaaggtagtacttctcatgagattagtagtaaagtagtatctaaaacaaaaaatgatgataaaaatgttcctgaatccgagcaagaaactagtagtaataacgaaattgatcaatctcaagataagcaggaaaaagaagaacaagcaattcctgaagatcaaaatgatcaatctcagaatacaaataatcaagatcctaatgacgcaagtgaagaagatgatgaagatgaagtatctgttgaagattatgaaaacaatgtaaaagattttcatagagtgaaaatgcaagaggtgaaagatcttctagcagagaaaaataatcaagaacatcttatgtacattggtcgcccaacatgttattactgccgacaattttcacctgatttaaaagatttcaatgaaatcgttaaaggtaagctgctttatttcaatattgatgatgaagaaggagcacatgattatgcttttaaggttattggtattccaggaacacctacaacgatgagatttatgaatggaaaattgataagtgcttggataggtggagaaaaaacaggacaagagctacatgattttttgtattctgacacagctaataaattagtagaacaggttgtaattaaaaatcaatcgaatgatacggctactcaagcagataatgatgtcgttgcatctgagagcgataaaacacctgaagtgactgtagaggaaaataatcaagcgcagtctaataatgatgtcgctattactaacttcgctgagaatagtgtatttgaaaatgctaaaaatgttgctagttctactgcggatttaactcaagtagcgacgggcgatcaagatgatgtagctcctaaagctgaaactaaaaataaaactgtgaagaaaccaataaaacataaaattgtagccaataaggttaagaaacaagctaaattgcataagacgaatattattatacctatgtccgctaaaaaacgtgaagatgtaaaagaaaataatcaatatgatacggtaaaagtacacggtacatctcctaatgcaattaaggacaaacaagctagaattactatgttgaaggaacttgagaatgatacttcagatactatttctactgtgtctttgccgtctactggtgagaagaaaaatatctggattcaattaatgggaatgattagtgttctagttagtgtagttttaggtatttcgttaagaaagaaaactaaggaggaaaag

SEQ ID NO: 140 - protein, 438 aa, Lactobacillus acidophilus
MNKKNVSMLMLSPAILLMMNSTIVHADKGSTSHEISSKVVSKTKNDDKNVPESEQETSSNNEIDQSQDKQEKEEQAIPEDQNDQSQNTNNQDPNDASEEDDEDEVSVEDYENNVKDFHRVKMQEVKDLLAEKNNQEHLMYIGRPTCYYCRQFSPDLKDFNEIVKGKLLYFNIDDEEGAHDYAFKVIGIPGTPTTMRFMNGKLISAWIGGEKTGQELHDFLYSDTANKLVEQVVIKNQSNDTATQADNDVVASESDKTPEVTVEENNQAQSNNDVAITNFAENSVFENAKNVASSTADLTQVATGDQDDVAPKAETKNKTVKKPIKHKIVANKVKKQAKLHKTNIIIPMSAKKREDVKENNQYDTVKVHGTSPNAIKDKQARITMLKELENDTSDTISTVSLPSTGEKKNIWIQLMGMISVLVSVVLGISLRKKTKEEK

SEQ ID NO: 141 - DNA, 588 bp, Lactobacillus acidophilus
  CDS (1)...(588)
  misc_feature (0)...(0): ORF 1794
atgaatagcaaagactatgaaagtactgaattctattcttataaatttaaaaatttttcaactatgattatcattcctatggcacttttagtatttatcttgataattggctctttctttgcaatcagacagagtacagttacatctactggaattgtagaaccacaaagtacacttgatattgccaataaaaattatcatgagggacaaattattaaaagaaatagaagtaaatggatggttcatctagatgataaaaaagaaaatatagtgcatttattaccaataattaaagcaaaaaaatcagttaatatcgttacatatttccctggtaataaaattggtgcaattaaaaaaggacaacccttacattttcaattatctaacgccaatggaacaacagatagactagttggggaagtgaaagaagtaggaatataccctgttaacttacacggaaacaatgtttacgaagtgatttgtaaagctaaattagataaagatgtgaagtatggaatggaaggcaatgcaccaattattacaggaaagagcacatattttgaatattttaaggataaaattcttaac

SEQ ID NO: 142 - protein, 196 aa, Lactobacillus acidophilus
MNSKDYESTEFYSYKFKNFSTMIIIPMALLVFILIIGSFFAIRQSTVTSTGIVEPQSTLDIANKNYHEGQIIKRNRSKWMVHLDDKKENIVHLLPIIKAKKSVNIVTYFPGNKIGAIKKGQPLHFQLSNANGTTDRLVGEVKEVGIYPVNLHGNNVYEVICKAKLDKDVKYGMEGNAPIITGKSTYFEYFKDKILN

SEQ ID NO: 143 - DNA, 2160 bp, Lactobacillus acidophilus
  CDS (1)...(2160)
  misc_feature (0)...(0): ORF 1796  plnG
atgctactacaatataaatcaatctatgtaccacaagtagacgaatcagattgcggtgttgcctgtttggctatgattcttaagaaatatcattctagagtatcattagcacatttgcgccattcagcacgtactaatttagaaggaactaccgcccttggcttagtcaaaacagcacaaacatttaatttgaaaactgaagcggtcaaagctgatatgtccttgtttgatccagatacggatatccaatatccttttattgttcatgtcttaaaacaaggcgaattactccactattatgttgtacttaaagcaactaaaaattatttagtaattgctgatccagatcctagcgttggtttaacgaaaatgtctaaagaaaaattctctcaagaatggactggtattgccctttttatggttcctaatgacgattttgagccagttaaggagaaaaaacgaaatctttggtcgttgtttccatatatgttcaagcaaaagaaattagttactaatattattttggccgcccttttaatgacaattattagtatttgtagttcatatttcttacaaggtttaattgatacttatattcctaatggcacatatcaaaccttatcaattctagccatcggtttattgatagcatatgtctttaattccatcttttcttatggtcaaaactttttgttaaatatcttaggacaacgattaagtattgatcttaatttacaatatattcgccatatttttgaattaccaatggaattttttgtgactcgtagaacaggtgaaatcacttctagattctctgatgctagtcgaattattgacgccttagctagtacagttatttcattatttcttgacctttcaattgtaattgtaatgggaattgttttggcaattcaaaactctactttattcatgattactttgttagcactgccagtatacgctgtagtgattcttagcttttctaagaaatttgaaaagctgaacaatgatcagatggaaagtaatgcagttttaagttcttcagtaattgaggatattcaagggattgaaacgatcaaggctttaaatagtgaacagacacggtaccgtaagattgatagtcaatttgtcgattatctaaagaaatcctttcgttacagtaaaactgaatctttgcagtcagctctaaagactttcattcaactgtctctcaatgtgattatcctttgggtaggagccaaagttgtaatgaacggtcagatgagtatcggtcaattaatgacatttaatgcattgctatcatattttgtagatccacttcagagtattattaatcttcagccaaccttacagtctgctaatgtagctcaaaatcgattgaatgaagtatacatggttaagagcgagtttcagaaagatgtccagattagggatgcaaagcaattagtaggagatattgaataccataatgtcgattatcattatggttatggagttgatgttttaaaggacgttaatttaaagattaagcagaatgataagttggcgatcgtaggaatgagtggctcaggcaagtcaaccatggtaaagcttttagttgattttttctctccaagcaaaggcaagttaacttttaatggatttgattctactaaagtagataagcatgtcttacggtcatacgtaaactatgttccccaaacaccatacatcttttcaggaacaatcaaagaaaatctgctcttaggtagtcgaccagatattacagaagaagatgtattgaaagcttgccagatagcagagattgagtctgaaatcgagcaattaccattgcaatttgaaactaagatggatgaaaatgccaagattttatccggtggacaaaagcaaaggttaactattgcacgtgcattattgtcaccagctaaggttttgatttttgatgaagccacaagtggacttgatacgattacggagaaaaaagtagtagataacttaatgaaattgaagaataaaactattatttttatcgcccatcgtttagcaattgcgcaaaggactaataatattgtggttgtagaccatggtcaaattgttgagcaaggaagccatgatgaattaatgcaaaaacatggattctattataacttagttgaaaat

SEQ ID NO: 144 - protein, 720 aa, Lactobacillus acidophilus
MLLQYKSIYVPQVDESDCGVACLAMILKKYHSRVSLAHLRHSARTNLEGTTALGLVKTAQTFNLKTEAVKADMSLFDPDTDIQYPFIVHVLKQGELLHYYVVLKATKNYLVIADPDPSVGLTKMSKEKFSQEWTGIALFMVPNDDFEPVKEKKRNLWSLFPYMFKQKKLVTNIILAALLMTIISICSSYFLQGLIDTYIPNGTYQTLSILAIGLLIAYVFNSIFSYGQNFLLNILGQRLSIDLNLQYIRHIFELPMEFFVTRRTGEITSRFSDASRIIDALASTVISLFLDLSIVIVMGIVLAIQNSTLFMITLLALPVYAVVILSFSKKFEKLNNDQMESNAVLSSSVIEDIQGIETIKALNSEQTRYRKIDSQFVDYLKKSFRYSKTESLQSALKTFIQLSLNVIILWVGAKVVMNGQMSIGQLMTFNALLSYFVDPLQSIINLQPTLQSANVAQNRLNEVYMVKSEFQKDVQIRDAKQLVGDIEYHNVDYHYGYGVDVLKDVNLKIKQNDKLAIVGMSGSGKSTMVKLLVDFFSPSKGKLTFNGFDSTKVDKHVLRSYVNYVPQTPYIFSGTIKENLLLGSRPDITEEDVLKACQIAEIESEIEQLPLQFETKMDENAKILSGGQKQRLTIARALLSPAKVLIFDEATSGLDTITEKKVVDNLMKLKNKTIIFIAHRLAIAQRTNNIVVVDHGQIVEQGSHDELMQKHGFYYNLVEN

SEQ ID NO: 145 - DNA, 702 bp, Lactobacillus acidophilus
  CDS (1)...(702)
  misc_feature (0)...(0): ORF 1838  ABC transporter
ttgatccagcaaaggcgattggtgaataaaatggcagtaattgaattaaaaaatgttaagaagatttatggtaaaggcgatgcgcaagttatagctttacaagatattaattttgttgctaataaaggtgaagttgtcttaataatgggaccatcaggtgcaggaaagagtacatttttaacaatcgctggttctttgcaaaaacctacttcaggtgaggtaataattgatggtgatgatatcggcaacttatcagctaaaaagagtaatgcacttcgcttgactaaaattggttttgtattacaagcatacaatttggttccatttttaacggttgaggaacaatttgttttagtagataaagtcaaaaagcaaaataacctctccaaagatgaattggataagttattaaagcagttaggaattacgaagttattgaaaaaatatcctggggaattatctggtggtcaacaacaaagagcagcaattgcacgtgcactttatgctaatccagaaattcttttggcagatgaacctactgcttcacttgataccaaaaacgttgaagaagtaggacaattatttaaagatctagctaaaaagcgtaataaagctgtgatgttagttactcacgatccgcgtctagaaaaatatgctgatcatatttatgagatgatggatggtaaaatgactcagaaaaaa

SEQ ID NO: 146 - protein, 234 aa, Lactobacillus acidophilus
MIQQRRLVNKMAVIELKNVKKIYGKGDAQVIALQDINFVANKGEVVLIMGPSGAGKSTFLTIAGSLQKPTSGEVIIDGDDIGNLSAKKSNALRLTKIGFVLQAYNLVPFLTVEEQFVLVDKVKKQNNLSKDELDKLLKQLGITKLLKKYPGELSGGQQQRAAIARALYANPEILLADEPTASLDTKNVEEVGQLFKDLAKKRNKAVMLVTHDPRLEKYADHIYEMMDGKMTQKK

SEQ ID NO: 147 - DNA, 1059 bp, Lactobacillus acidophilus
  CDS (1)...(1059)
  misc_feature (0)...(0): ORF 1839  permease
ttgtttttagcaattaaagaaataaagcatgaaaaattacgatatgggttaatcattttaatgatctttttgattagctatttaatttttatgttgtcatcattagcagtgggattagctagtgaaaatactcaggcgattgagagctgggacgctcaaaaaattgtccttaataagaattctaatattagtatgagtcaatccgctcttactaaagaagatcttaaggatgtaaaagtaggaaaatctgaagcctatgttggccaaatgggtgcagtagttaaagctaaagaccgtagttctgtatctgcacaatttttgggaataaagaaaaatcagtttatttatcaagaacaaaaactactttctggtaaaaaagcgcaaaatagcaatcaagttacagtagatagtagttttaaagataaaggatataaattaggcgataaaattagcctgaatggctcaagcaaaaaatacaaaattgttggttttgtaaaaaatgctaagattaatattgcaccaattgtttatggttcattttctacatggaagaaaatgcgaatggtagcgccaaatgttcaagcatcagcaatcctttcaagaaataagaattataaatttaatcatagagatgcaaagacttattcaattgatagatatatcagcaagttgccaggatatactgcacagaatttgacatttggtctaatgattggctttttatttgtaatatcattaattattattgctgttttcttatatatcttaactatgcaaaagatgcataattttgccgttatgcgcgcacaaggtattccaagcaaaactttggttggtgcaacgatcagtcaatcaattattttagttgcggttggcgtaattattgcattaattttaatgtggattactgcagctgttttaccagcagctgtaccaatgaatttcacaccattaattatggttagtggcacagtaggaatgctagtaatggggattattggtagtttgattccaattagatcaattatgaaggttgatccagcaaaggcgattggtgaa

SEQ ID NO: 148 - protein, 353 aa, Lactobacillus acidophilus
MFLAIKEIKHEKLRYGLIILMIFLISYLIFMLSSLAVGLASENTQAIESWDAQKIVLNKNSNISMSQSALTKEDLKDVKVGKSEAYVGQMGAVVKAKDRSSVSAQFLGIKKNQFIYQEQKLLSGKKAQNSNQVTVDSSFKDKGYKLGDKISLNGSSKKYKIVGFVKNAKINIAPIVYGSFSTWKKMRMVAPNVQASAILSRNKNYKFNHRDAKTYSIDRYISKLPGYTAQNLTFGLMIGFLFVISLIIIAVFLYILTMQKMHNFAVMRAQGIPSKTLVGATISQSIILVAVGVIIALILMWITAAVLPAAVPMNFTPLIMVSGTVGMLVMGIIGSLIPIRSIMKVDPAKAIGE

SEQ ID NO: 149 - DNA, 564 bp, Lactobacillus acidophilus
  CDS (1)...(564)
  misc_feature (0)...(0): ORF 1840  regulator
gtgacaaaacgtcataagctgaaaaggggggatgattatatggttaagcaaacttttaaaaatttaccgttagctaaacgtaaacgtattgaagatgtattattagaggaatttagtacatatcctttagcaaatgctaaagtatcacatattgtgaaaaaagcagatattgctcgtggtgcattttataaatacttcgatgatttaacagatgcatatatttatatgtattacaaggctattgatactattcatgcaaatatggcaccgggcgaaaaatatgatccagatcatttttacgatcgagttgtaaaatttattgataaaacacaaaacagtaaatttgaaccaatgatgaaattgcatatgtcacaaaatgagtatttgattccagatacttataagatgtattctagacagcttttaaacttagatgctcaaatgtggagtgcaatggttttaagtcatgagataattaatctttgtttatcagatccggaaaatcgtgagaaaaatttagctagatacaaaaagagcttatacatgcttaaaaaggggatggat

SEQ ID NO: 150 - protein, 188 aa, Lactobacillus acidophilus
MTKRHKLKRGDDYMVKQTFKNLPLAKRKRIEDVLLEEFSTYPLANAKVSHIVKKADIARGAFYKYFDDLTDAYIYMYYKAIDTIHANMAPGEKYDPDHFYDRVVKFIDKTQNSKFEPMMKLHMSQNEYLIPDTYKMYSRQLLNLDAQMWSAMVLSHEIINLCLSDPENREKNLARYKKSLYMLKKGMD

SEQ ID NO: 151 - DNA, 708 bp, Lactobacillus acidophilus
  CDS (1)...(708)
  misc_feature (0)...(0): ORF 1913  abc transporter
ttgataatcatggcttatatagaaattaaaaataataccaaaacttatcaatcgggcaatacgactatctatgctaataaagatatctctttttctgtaaataaaggcgagttagtcatcattcttggctcatcgggtgctgggaagtctactttgcttaacatccttggaggaatggaacctaataccagcggagacgtaatcgtagctggtcaaaatatcgcaggttataacgccaaacaactaactacctatcgtagaaatgatattggttttgtcttccagttttacaacttaattcctaatctaactgctaaagagaatgtggaactggctgctcaaattgtaccgaacgcaatgagtggtgacgaagctcttaaacaagttgatttagcaaatcgtgctaataattttccagctcaattatccggtggtgaacagcaacgagtagcaattgcccgagccattgctaaaaaacctgctttgcttttatgtgacgagccaacaggggcattagattatcaaactggtaaaagaattttgaagattttacaaaacatgagtcggaaaaatggttctacagttttaatcgttacccataacgctgctatcgcaccaattgctgataaagttattcgtattcatgatggtagtgttaaagatattaaaattaataaaaagcctgctgatataagtacaattgaatgg

SEQ ID NO: 152 - protein, 236 aa, Lactobacillus acidophilus
MIIMAYIEIKNNTKTYQSGNTTIYANKDISFSVNKGELVIILGSSGAGKSTLLNILGGMEPNTSGDVIVAGQNIAGYNAKQLTTYRRNDIGFVFQFYNLIPNLTAKENVELAAQIVPNAMSGDEALKQVDLANRANNFPAQLSGGEQQRVAIARAIAKKPALLLCDEPTGALDYQTGKRILKILQNMSRKNGSTVLIVTHNAAIAPIADKVIRIHDGSVKDIKINKKPADISTIEW

SEQ ID NO: 153 - DNA, 2538 bp, Lactobacillus acidophilus
  CDS (1)...(2538)
  misc_feature (0)...(0): ORF 1914  abc transporter
gtgagtaaaatgcacaaaaacattttatggaaagacgcttttcaagccataacgcattcacttggccgttatattgccattattttactgatggggctgggtacatttgcttttgtaggtttaaaaatgactggtcctgatatgcgagcaactggtaatgatttttttactaagcataatcttgctgatgtcacagttacttccaactacggcattaattcaacagatcgaatgaccattcggaatttacctgaagttaaacaagcaagctttggctattttcaagatgtaaaaactaagcaaactaaagatacgttacgtgtattttctcaatcaaacaatatttcaagttatgaattgattaaaggtcacttacccaataataaaaatgagattgcattatcttatttgcttaaaaggaaatatcatttagatcaaaaaatcacttttgaaaagcctggtattctaaaaaatagaacctataaaatcgtaggctttgttaagtcgagcgaattcttagataaaaatcaaattggtcaaactaatattggtaatggtcatttaacaagcattgcagttactacccataacgcttttgcgtctcctgtttaccaagtttcacgtgtaacttttaaaaatacggataatttaagtccctttagcgtaacttatcgtaattacgtttatcgagatcaaaagaaattacaagatgcgttaaatcaaaatcgtgctgataagtatcaaaaatacgtgcagctttatcaaaatcaatatcgtaaacaagctgctgaaaaaatgatgaagcggggcattccaatcagcccaggtgatattaaagttccaaaaagcaaaataaaaattgcttatccaagttacacaatcagtagccgtgaagaaagtcagggctactcatcttatcgtgccgattcagaacgcgtggaagtattagctaatgtcttccctgtcttcttattcgcggtcgctgctttagtcagcttaactaccatgatgcgttttgtagaagaagaacgtaccaatatcggtaccttaaaagctttaggctatggcaatggtgctattgcaatcaagtttttactttacagtacttcagctgctgttatcggagtcgcaattggtgctagtttagggtatacattcttacctaacttaattatcaaagcatatttagctaattctactttaggaacaggctatcagctaaattttgcgtggaagcctctcctcatttcactaacagttgcattaatttcaactacagtcgtttcaatgtttacgcttcatgaaactttaaaggaaaagccttctgcattacttttacctaaaccacctaaaaatggctcaaggattcttcttgagcgcattccttggttatggaagcatatgaatttttcagcaaaagttacagctcgtaatatttttcgttataagagcagaatgctaatgacgattttgggtgtagctggttgtaccggactgctagttatgggatttggtattcgtgattcacttcaaggcattggtaacattcaatattcaaccattcaaaaaaatgatgtgatcgctctaaaaagttccaatgttactaaaaatgatcagcaaaaattaaacaatctttttaaagaaaaagatattaaaactacaactgctgttcaatatcagcaattgaaaaaacatattaattcaactggttcaaccgaaaatattatgttgatcgcaccaaaatccactaaagacttccgcaagtcgatcaacctaagagaacgtcaaagcaagaaaaaattagctttacctaacgatggagtagtaatttccgaaaaattagctaatattttacatgctaaaaaaggttccacaatttcgttaacaaacaatcatggcaaaacctatcgcttcaaggttagcggaatttgtgaaatgtacttaggtcattatattttcatgaatcaaaaagaatatcaaaggactgtgggcaattatcacgtaaacgcgtatttagttactgcacgtaagcgaaacttaatcaataaagttagtcgccaattagttcaaactgcagcaattgaaacggttatttctaactcatcaaatagaaatcttttaggtagttttactggcagtctaaatgaagttatctttattttgattttaatttcagggatgcttgccatagttgtcatctacaatttaaccaacatcaatgtcgctgaacgaattcgcgaaatttctacaattaaagtgttaggcttctacaataatgaaactactatgtatatttatcgtgaaacgatcattttatccggtattggaattattgtgggctttggctttggttggtggttgcatcacttcattattactagtctgccaccagatattgcgatgtttgatccgaatatgtatccactaaacttcgtattctctgcgctaattcctgcccttattactgcagttttagcaattgtcgtacaccataaaattaagagcattaatatgttagatgctttgtcatcaatcgat

SEQ ID NO: 154 - protein, 846 aa, Lactobacillus acidophilus
MSKMHKNILWKDAFQAITHSLGRYIAIILLMGLGTFAFVGLKMTGPDMRATGNDFFTKHNLADVTVTSNYGINSTDRMTIRNLPEVKQASFGYFQDVKTKQTKDTLRVFSQSNNISSYELIKGHLPNNKNEIALSYLLKRKYHLDQKITFEKPGILKNRTYKIVGFVKSSEFLDKNQIGQTNIGNGHLTSIAVTTHNAFASPVYQVSRVTFKNTDNLSPFSVTYRNYVYRDQKKLQDALNQNRADKYQKYVQLYQNQYRKQAAEKMMKRGIPISPGDIKVPKSKIKIAYPSYTISSREESQGYSSYRADSERVEVLANVFPVFLFAVAALVSLTTMMRFVEEERTNIGTLKALGYGNGAIAIKFLLYSTSAAVIGVAIGASLGYTFLPNLIIKAYLANSTLGTGYQLNFAWKPLLISLTVALISTTVVSMFTLHETLKEKPSALLLPKPPKNGSRILLERIPWLWKHMNFSAKVTARNIFRYKSRMLMTILGVAGCTGLLVMGFGIRDSLQGIGNIQYSTIQKNDVIALKSSNVTKNDQQKLNNLFKEKDIKTTTAVQYQQLKKHINSTGSTENIMLIAPKSTKDFRKSINLRERQSKKKLALPNDGVVISEKLANILHAKKGSTISLTNNHGKTYRFKVSGICEMYLGHYIFMNQKEYQRTVGNYHVNAYLVTARKRNLINKVSRQLVQTAAIETVISNSSNRNLLGSFTGSLNEVIFILILISGMLAIVVIYNLTNINVAERIREISTIKVLGFYNNETTMYIYRETIILSGIGIIVGFGFGWWLHHFIITSLPPDIAMFDPNMYPLNFVFSALIPALITAVLAIVVHHKIKSINMLDALSSID

SEQ ID NO: 155 - DNA, 234 bp, Lactobacillus acidophilus
  CDS (1)...(234)
  misc_feature (0)...(0): ORF 1915
atggcaagaaaacactttgaaatgaacagcgatgttcgtaaattaattgacaaatacagtgagattcacgacgttgactttagcgaattagttaacaaggctttaaaattctaccttgttaaccaaatgagtcacaaagatgtccaagaagctttaagagaagcagatattgaagcatctaagtacgttgacgaggctatgcgttcaagtatgggcgatattaaccgtaatttt

SEQ ID NO: 156 - protein, 78 aa, Lactobacillus acidophilus
MARKHFEMNSDVRKLIDKYSEIHDVDFSELVNKALKFYLVNQMSHKDVQEALREADIEASKYVDEAMRSSMGDINRNF

SEQ ID NO: 157 - DNA, 1137 bp, Lactobacillus acidophilus
  CDS (1)...(1137)
  misc_feature (0)...(0): ORF 1938
atggaaatagctgaaaaaggcataagggaggatattatgatacaggagatcatcgcctttttaggaagacgcggcgaatttttttacatttcagtttttatgcttctgatgtttttcatatttttaatttcttggttaattgagccgcggcgcttaattaatggggttttatttacaatcttttttatttcagtattcgcttggatcaccgttatgatcaataagagcaccagccgaggattacaacgagcatataatctactattactgatcgttttcttcggtattattctaatactagtttttgcctggctatttcttttttggaatgcctattttgtctggaaatatgagagtcacactttacctaatctattgaccttattttctggttttattgcgttaatctttagcgttatcttcatcttagggccgggacgctatttgcctcattggttaagtgccctactcgcttctattcctgctattgctatttatctaggattagttttatacaactttttagtaaatttgctcttatatcaaatttatcctcgccattacaaacaagactacctaattgttttaggtgcaggactaattaatggtgatcaagtttctaagttactagctgcacgaatcaatcgagcaatccagttctctaatcgccaatatcaaaaaggtagaaaacgtcctattattatcatgtccggtggacaaggtcctgatgaaaaagtacctgaggctttagctatggccaaatttgcacaacaccgtggagtttcaccagatcatattttaattgaagatcaatctaaaaatacttaccaaaatatgcttttttctaagcaactagctactaacgactttgggggtcccaattttaaagcaacattttttagcaacaactaccatatttttagagctgcgcttttagctaaagaagtgggcctaaaagctaatggcgtcggtgcttttactagactctattatttacctaacgcaattattcgtgaatttgctggtgtatttgtcatgcataaacgccgccatttcgttatcatgggagtaatagttttattctttatcttgcaagctattttagctgcagcaggtatcgttaaattcaacgtaatt

SEQ ID NO: 158 - protein, 379 aa, Lactobacillus acidophilus
MEIAEKGIREDIMIQEIIAFLGRRGEFFYISVFMLLMFFIFLISWLIEPRRLINGVLFTIFFISVFAWITVMINKSTSRGLQRAYNLLLLIVFFGIILILVFAWLFLFWNAYFVWKYESHTLPNLLTLFSGFIALIFSVIFILGPGRYLPHWLSALLASIPAIAIYLGLVLYNFLVNLLLYQIYPRHYKQDYLIVLGAGLINGDQVSKLLAARINRAIQFSNRQYQKGRKRPIIIMSGGQGPDEKVPEALAMAKFAQHRGVSPDHILIEDQSKNTYQNMLFSKQLATNDFGGPNFKATFFSNNYHIFRAALLAKEVGLKANGVGAFTRLYYLPNAIIREFAGVFVMHKRRHFVIMGVIVLFFILQAILAAAGIVKFNVI

SEQ ID NO: 159 - DNA, 2337 bp, Lactobacillus acidophilus
  CDS (1)...(2337)
  misc_feature (0)...(0): ORF 1939  ABC transporter
atgctacaactaaaacatatttttaagtcatataaagtgggcgataatattactcatgccctagatgatgttagtatatcctttcgtgatcaagaattcgttgcaatcttaggtcctagtggatctgggaaaacaactatgttaaatgttatcggtggacttgatcgctacgataaaggtgatttgattattaatggtaagtcaaccaaaaatttcaaagaaatcgattgggatgcctatcgtaacaataccgtaggttttatttttcaaaattacaatctgattccccacctctcaattatcgccaatgtggaattaggtatgaacctttctggtgttcctaaaaaagaacgccatgaaaaagctgttaaagctttaactgaagtcggtttaaaagaacatcttaataagcggcctaaccaattatcaggcggtcaaatgcaacgtgtagcaatcgcccgtgcaattgcaaatgatccagatatcttgctctgtgacgagccaactggagcgcttgatactgagacttcagttcaaatcatggaattaatcaaaaagatctctaaagatcgtttagtaattatggttacccacaatcctgagttagctgaaaaatatgctacaagaattgttaacttccaagatggaaagattcgccacgactctaaaccatttgaaccaaaagaagaaaaagataccttccacttgaagcggactaagatgtcatattggaatgctatcaaacttagctttaccaatattatgaccaaaaaaggtagaacaattttaacagctttcgcttcaagtatcggtattatctctatcgcaatagtgttagcgatttccaatggtttccaaaaacaaattaacaccaccatgagtaaagctttagcgaaatatccgatctcaattactcaaactgctacagatatgacttcaatgaatgagcggaatgattctgacaaaaatgtcaagaatcgtggctatataattgcacaaaatgatcaaagtcaacaaactcaacatactaataaaattacacaaaaatatgtcgattacgttaaaaagatcaatcctagttacgctaataatatttcttaccaacgcgcagttaacttaaacttactttctaaagtaaatggcaaaactgaacgcgttcaattttcaaatgcggatcctaatcaaggttcatctgttttacaagcacgtgctcaagcaatgagctcaatgggaattggttcatccgtttttccaacgactttgaacaaaaataaaggttcatttttaaagcaaaattaccagctgttatctggtgcctggcctaccaaagccacagatttagttttagtagctgataataaaaataccgttaatattaattcattgaagaatctgggctttgatatttctaataaagaacagattaaatttgataaattagttggtaaaaactttagactcgtttctaacaatgagtactaccaagaattaccaaatggaatgttcgttccaagaaatgtgaataattccatgtacaacaacgctaaaacaaaattaaaattagttggtgtcattagacctaaaaatgaagattcgatggctcttctatcaactggcatcgcatatagcgatcgcctttcacaacaagttatcaataataacaagaattcggcaattgtcaaagcccaacaaaagagtaatcgtagcgttttaactaatcaaaagttaaatagtattgaaaagaaaaccactatgcaaacattaggtggttcaagcattccaacaggaatcatgatttatcctaataattttgatgataaagacaaggtactcgattacttagacaactggaacaaaggcaaaaagaaagctgacaagattgtttataccgatatgtctagcgccgttacaacgatgaccggtggacttcttaatggtattaccactatcttagttaccttcgctgccatttcgttgattacttcgatgattatgattggtattttgacttatacttcagttcttgaaagaactaaagaaatcggtgtcttaaaagcactaggtgctcgtaagaaagatattacacgcgtatttgacgcagaaacatttatcttaggtgtcttctccggcgtacttggtatttttattgcatacttgttaacattcccaatcaatagtgtcatttacaatctcacagatttagctaatgtagcacaacttgatccaaaagctgcattaattttaattattatctcaacagttcttaccttgttgggtggacacattcctgcaagaatggcagccaaaaaagatgccgcaattgcattacgaagcgaa

SEQ ID NO: 160 - protein, 779 aa, Lactobacillus acidophilus
MLQLKHIFKSYKVGDNITHALDDVSISFRDQEFVAILGPSGSGKTTMLNVIGGLDRYDKGDLIINGKSTKNFKEIDWDAYRNNTVGFIFQNYNLIPHLSIIANVELGMNLSGVPKKERHEKAVKALTEVGLKEHLNKRPNQLSGGQMQRVAIARAIANDPDILLCDEPTGALDTETSVQIMELIKKISKDRLVIMVTHNPELAEKYATRIVNFQDGKIRHDSKPFEPKEEKDTFHLKRTKMSYWNAIKLSFTNIMTKKGRTILTAFASSIGIISIAIVLAISNGFQKQINTTMSKALAKYPISITQTATDMTSMNERNDSDKNVKNRGYIIAQNDQSQQTQHTNKITQKYVDYVKKINPSYANNISYQRAVNLNLLSKVNGKTERVQFSNADPNQGSSVLQARAQAMSSMGIGSSVFPTTLNKNKGSFLKQNYQLLSGAWPTKATDLVLVADNKNTVNINSLKNLGFDISNKEQIKFDKLVGKNFRLVSNNEYYQELPNGMFVPRNVNNSMYNNAKTKLKLVGVIRPKNEDSMALLSTGIAYSDRLSQQVINNNKNSAIVKAQQKSNRSVLTNQKLNSIEKKTTMQTLGGSSIPTGIMIYPNNFDDKDKVLDYLDNWNKGKKKADKIVYTDMSSAVTTMTGGLLNGITTILVTFAAISLITSMIMIGILTYTSVLERTKEIGVLKALGARKKDITRVFDAETFILGVFSGVLGIFIAYLLTFPINSVIYNLTDLANVAQLDPKAALILIIISTVLTLLGGHIPARMAAKKDAAIALRSE

SEQ ID NO: 161 - DNA, 114 bp, Lactobacillus acidophilus
  CDS (1)...(114)
  misc_feature (0)...(0): ORF 453  mannose-specific phosphotransferase system component
atgaaaccagatcgcgttatcgttgtttctgatagcgtagctaaggatgatttgcgtaagagtatgattcgtgaagctgccacctgcaggcgtaaaggctcatactgttccgct

SEQ ID NO: 162 - protein, 38 aa, Lactobacillus acidophilus
MKPDRVIVVSDSVAKDDLRKSMIREAATCRRKGSYCSA

SEQ ID NO: 163 - DNA, 315 bp, Lactobacillus acidophilus
  CDS (1)...(315)
  misc_feature (0)...(0): ORF 454  PTS system mannose-specific, factor IIAB
atggcagaaattgctaaagatccaagatttggtgatactcatgcacttcttttattcgaaaatccagaagacgttttaagagctatcaaagatggtattgatattaaagaagttaacgttggttcaatgtcatacaaggaaggcgatgttaacgccaataatgtattatcaatggaccaaaaggatgttgatacattccgtgaacttgaaaagatgggtgttaagtttgacgttcgaaaagttccttcagacgcaccaggcaatatggatgctatcttaaataaagctcagcacttacttgatgaacaaaagaaa

SEQ ID NO: 164 - protein, 105 aa, Lactobacillus acidophilus
MAEIAKDPRFGDTHALLLFENPEDVLRAIKDGIDIKEVNVGSMSYKEGDVNANNVLSMDQKDVDTFRELEKMGVKFDVRKVPSDAPGNMDAILNKAQHLLDEQKK

SEQ ID NO: 165 - DNA, 807 bp, Lactobacillus acidophilus
  CDS (1)...(807)
  misc_feature (0)...(0): ORF 455  PTS system mannose-specific, factor IIC
atgaacgctatacaaatgattttggtagtggccgttgcctttcttgcaggtacagaaggtatcttggatgaatggcaattccaccaaccattagttgcatgtacattaattggtttagtaacaggccatttggacttaggtgttatcttaggtggtcaattacaaatgatcgctttaggttgggcaaatattggtgccgctgttgcaccagatgccgctttagcatcagttgcttcagctattatcttggttgaaggtggtcaaggtgttaagggtatcggtactgctactggtattgctattcctttagctgttgctggtttgttcttaactatgattgtacgtactatttcaactgctatcgttcacgttatggacgcagaagctaagaagggtaactggcgtatgatcaacttgtggcaatggattgctgtatgtttgcaaggtttgagaatcgctatcccagctgctcttcttttggcaattccttcagaaactgttaaaggttggcttgcaatgatgccacaatggttatcagaaggtatgaccatcggtggtggtatggttgttgctgtaggttatgctatggttattaacatgatggcaagtaaagaagtatggccattcttcgcaatcggttttgctttagctgctatcaaggacttaactttgatcgctcttggtgctatcggtctttcaatggctttgatgtacttagctcttgaatcaaaaggtggcaacggcggttcaaacaactctggttctgctggtaccggcgatccactcggcgatatcattgatgattat

SEQ ID NO: 166 - protein, 269 aa, Lactobacillus acidophilus
MNAIQMILVVAVAFLAGTEGILDEWQFHQPLVACTLIGLVTGHLDLGVILGGQLQMIALGWANIGAAVAPDAALASVASAIILVEGGQGVKGIGTATGIAIPLAVAGLFLTMIVRTISTAIVHVMDAEAKKGNWRMINLWQWIAVCLQGLRIAIPAALLLAIPSETVKGWLAMMPQWLSEGMTIGGGMVVAVGYAMVINMMASKEVWPFFAIGFALAAIKDLTLIALGAIGLSMALMYLALESKGGNGGSNNSGSAGTGDPLGDIIDDY

SEQ ID NO: 167 - DNA, 921 bp, Lactobacillus acidophilus
  CDS (1)...(921)
  misc_feature (0)...(0): ORF 456  PTS system mannose-specific factor IID
atggctgataaaaagaaaattgaattaaccaagcgtgaccgttttaacgttatgtggcactcacaattccttcagggttcatggaactatgaaagaatgcagaatggtggtttcgcttactcaatgattcctgctttgagaaagttatacccagacaagaaagatttgtctgctgctatgcaaagacacttagtattctttaacacccacccatacttggcatctcctgtacttggtgttactttggctttggaacaagataaagctaacggtacaccagttactgatgatgctatccaaggtgttaaggttggtatgatgggacctttggctggtgttggtgaccctgtattctggtacactgttcgtccgattgttggtgctttaggtgcatcaatggccatcgcaggtaacgttatgggacctatcttattcttcgttatctggaatgtaatcagacttgcattcttatggtatacacaagaatttggttacaaggctggttcagctatcactaacgacatgtccggtggtatgcttcaaaaagttacccgtggtgcttcaatgatgggtatgttcgtcttgggtgccttgattgaacgttgggtaaacattaagtttacaccaatagtttcacaaacacctatccaaaaaggtggatatattgaatgggacaagcttccatcaggtgctaaaggtattcaatctgcccttgaacaatggaacatgggtaatggtaaggctttaactagtactaaggttactactttacaagacaacttggatcaattgattcctggtattgctggtcttcttttaacattcttctgtatgtggttgttaaagaagaaggtttcaccaatctggattattattggtatcttcgttgttggtgtattgttccacgtatggcacattctt

SEQ ID NO: 168 - protein, 307 aa, Lactobacillus acidophilus
MADKKKIELTKRDRFNVMWHSQFLQGSWNYERMQNGGFAYSMIPALRKLYPDKKDLSAAMQRHLVFFNTHPYLASPVLGVTLALEQDKANGTPVTDDAIQGVKVGMMGPLAGVGDPVFWYTVRPIVGALGASMAIAGNVMGPILFFVIWNVIRLAFLWYTQEFGYKAGSAITNDMSGGMLQKVTRGASMMGMFVLGALIERWVNIKFTPIVSQTPIQKGGYIEWDKLPSGAKGIQSALEQWNMGNGKALTSTKVTTLQDNLDQLIPGIAGLLLTFFCMWLLKKKVSPIWIIIGIFVVGVLFHVWHIL

SEQ ID NO: 169 - DNA, 333 bp, Lactobacillus acidophilus
  CDS (1)...(333)
  misc_feature (0)...(0): ORF 876  PTS system enzyme II protein
atggctgaacaaactattatgttaaattgtagtgctggtatgagtacttcacttttagtaactaagatgcaagctgctgctcaagaagaaggtattgacgctgaaatttttgcttgtcctgcttcagaagctgatgacaaaatggcacaaaaacaaattgactgtgttcttcttggacctcaagtaagttacatgagaggtgaatttgaaaataaggttaagggcaagggcaaagacggcaaggatattccattagatgtcattaacatgcaagactacggcatgatgaatggaaagaatgttttggctcaagctgaaaagttaattaagggc

SEQ ID NO: 170 - protein, 111 aa, Lactobacillus acidophilus
MAEQTIMLNCSAGMSTSLLVTKMQAAAQEEGIDAEIFACPASEADDKMAQKQIDCVLLGPQVSYMRGEFENKVKGKGKDGKDIPLDVINMQDYGMMNGKNVLAQAEKLIKG

SEQ ID NO: 171 - DNA, 768 bp, Lactobacillus acidophilus
  CDS (1)...(768)
  misc_feature (0)...(0): ORF 879  phosphotransferase system sugar-specific EII component
atgcctgcatcagttccatctggtgtttctaattcatttagtgccttaattcctggtttctgtattgcgttagtagttgctataattgaattgattttggtaactttaggaactgatatttttaaggtcctttacattccattttcattcattagtaatattgctgatacttggtggggattcctaatcattatcttcttgatccacttgttatggtggtttggtatccatggtgcaacaatcatgagttcattttatactcctattgttttggctaacatggctgctcacgtaaaaggggctacacacttctttgctggtgacccaatgaatgctttcgtaattatcggtggctcaggtgctactttaggtatggctatttggttagcctttggttcacgttcagcccaattgaaagaaattggtaaagttgaattagttccagccatcttcaacattaatgaaccgcttttgttcgggttgccaattgtttataatatcaatttattaattccattcatttgtgcgccacttgcttcaggcattgtaggctatgtcgctgtatcgactcatcttgtacctaagattattgttcagcaaccatggccaacaccagttggtttgagtggttatcttgctactgtaagttggcaaggggcagtactttctgtagtttgtgcgattgttgctttcttgatttggtttcctttcattaagcattacgataatgttcttcttaaaaaggaacaagcaggagctgctaagaac

SEQ ID NO: 172 - protein, 256 aa, Lactobacillus acidophilus
MPASVPSGVSNSFSALIPGFCIALVVAIIELILVTLGTDIFKVLYIPFSFISNIADTWWGFLIIIFLIHLLWWFGIHGATIMSSFYTPIVLANMAAHVKGATHFFAGDPMNAFVIIGGSGATLGMAIWLAFGSRSAQLKEIGKVELVPAIFNINEPLLFGLPIVYNINLLIPFICAPLASGIVGYVAVSTHLVPKIIVQQPWPTPVGLSGYLATVSWQGAVLSVVCAIVAFLIWFPFIKHYDNVLLKKEQAGAAKN

SEQ ID NO: 173 - DNA, 1680 bp, Lactobacillus acidophilus
  CDS (1)...(1680)
  misc_feature (0)...(0): ORF 1575  PTS system, beta-glucoside-specific enzyme II, ABC component
ttggggggtagggtcacagatgtttacaatgcttttgttcctctagttcatatatctaataattcaacaagtgatactaataaagcaaaggaaaacattattagtaaattgctcgatattttatcaggcatttttgtccctattattcatgctattattggtgctggtttactgaaaggaatcttgattttccttaacttttatcatttggtttcaccagcaaccagtacgtataaattattatcagttttttctgattctgcattctattttatgccaatacttttagcatatagttcagctaaaaaatttaagactaataaatatgttgctgtggccattgcaggtattttagttcacccagaattaatttcgatgatgtcaaaatcagcaagtgttaaatttttcggcataccatttacaagtgcgacgtattccactagtgtattaccaataattttgggtgtatgggtaatgtcatacatagaacgtggtcttaacaaaatcatacctaagattttaaggactgttttggttccgttattcactctattaattacagctccgataattttaggaattcttggaccaattggtacgattgttggtgatgcgattggtcaaggcacagttcagctttacttgcattatggtgtaatagctggaattcttgtaggtgctgcatatcctttccttgtcattatggggatgcatgttggttttactcccgtaatggttcaatccttatcaaaatatggtgtggattacatgatgggaatttttgtagcttccaactccgctgaagctggtgctactacagccgtatggcttaaaactaagaataaacaattaaaagaaatagcaggatcttccgcattgaatgctattatcggtgtcactgaaccagctctttttggtgttacttctaaattaaaaaagccattaattgccgtatctattggtggcgctgtcggaggtggaattgcaggattatttaaagtagctgcacaaggtgcaggtactggtccaattgcgggaattccattattcttcggaaaaactttcatttggtttattatctcatgtttagtatcttatgttgtttcctttattcttgcatatgtgattggatttgaggatattccaaatccagaagatttaagtcaaaagaattcaatggataatcatgaaaaaatagttactacagttgttgcaaatcaatctgtagcagatccagtaaatggtaatgttattcctcttagtgaagtgaaagataatgtattctcatccaagatgatgggagacggtgctgctattgtaccaaacgataataaaatttatgctccgtttgatggagtagttgaattagtatttgaaaccaaacatgcaattggtttaaagagctatgatggctgtgaattattaattcatgtaggtcttgatactgttgaacttaaaggaaagcatttcatttctcatgttattaaagatcaaaaagtgaaaaaaggcgacttgttattagaattcgatagagaggcaatatcaaaagaaggttatgatactacgatccctgttattgtgactaattctaaagatttcgaaaatattactaaaactaagaaaaaacaattacaacatggagaagaattgttaaaactaacagcaaaaaataaggagaat

SEQ ID NO: 174 - protein, 560 aa, Lactobacillus acidophilus
MGGRVTDVYNAFVPLVHISNNSTSDTNKAKENIISKLLDILSGIFVPIIHAIIGAGLLKGILIFLNFYHLVSPATSTYKLLSVFSDSAFYFMPILLAYSSAKKFKTNKYVAVAIAGILVHPELISMMSKSASVKFFGIPFTSATYSTSVLPIILGVWVMSYIERGLNKIIPKILRTVLVPLFTLLITAPIILGILGPIGTIVGDAIGQGTVQLYLHYGVIAGILVGAAYPFLVIMGMHVGFTPVMVQSLSKYGVDYMMGIFVASNSAEAGATTAVWLKTKNKQLKEIAGSSALNAIIGVTEPALFGVTSKLKKPLIAVSIGGAVGGGIAGLFKVAAQGAGTGPIAGIPLFFGKTFIWFIISCLVSYVVSFILAYVIGFEDIPNPEDLSQKNSMDNHEKIVTTVVANQSVADPVNGNVIPLSEVKDNVFSSKMMGDGAAIVPNDNKIYAPFDGVVELVFETKHAIGLKSYDGCELLIHVGLDTVELKGKHFISHVIKDQKVKKGDLLLEFDREAISKEGYDTTIPVIVTNSKDFENITKTKKKQLQHGEELLKLTAKNKEN

SEQ ID NO: 175 - DNA, 1917 bp, Lactobacillus acidophilus
  CDS (1)...(1917)
  misc_feature (0)...(0): ORF 1463; LacS
atggcaaatggtcataaaacttcggggaaacaaataatttcctatgcatcattctgtctgggcaacttaggacacgcagccttttatggtgtaatgagcacatactttattatttttattactagtggaatgtttagtggattagagcaatcggtagctgacaaactaatcggtctaatcaccggattaatggttttaataagaatcgtagaactagtaattgatccaattttaggcaatattgttgataatacaaaaacaaaatggggtaaatttaaaccatggatattcattggaaccatggttagtgcagtattattattaatcttgtttactgggattttcggtttagcacaaagtaattggattctttttgcaatccttttcgtaattatctatattggatttgatgtcttctattcattatctgatgtttcatattgggggatggtaccggctttaagtgaagattcacatgagcgtggtatttatacttctctaggtgctttttcaggtgctattggctggaatggattagcaattatcgtagttcctttagtaactggagttacttatgcagtgactggtaaaaatgaagagggagctcctggctggctcgcttttgcggccgtaatttcagctttggcgattatttgtgccatcattgtatgtttcggtactaaagaaaagcataacttaattagaaattcggctaagcaaaaaactactttacgtcaagttttcagtgctatttttcataatgatcaaatactttggccaagtctagcttacttagtattttcacttgccaatacaattaccaacggtgttttattctatctatataaattcgtaattggtaaaccaggagaattctgggtagtagggcttatagctactattattggattttgcgttagtccaatgtttccaattttaaacaaatatattccaagaaaatggctattcattgcaggtcaaacttgtatgatttgtgcatatcttttattcattttctgtcgtgataatgttgtattgatggacttaggtttgatcctgttcaacattaactttgcacaattagttactgttttgactttaactgatgccattgaatatggccaacttaagagtggtcaaagaaatgaagccgttgttttggctgtccgtccgatgattgataaatttactggcgctgtttctaacgctttggttggttatgtagctattgctgcaggaatgacgggaacggctacagctgcggatatgactgcacatgatattagcacttttaatactatggctttatatattccattagttttacctgcaatttcaattgtggtattcatgactaaagtaaacttgagtgaaaagaaacacgcacaggttgttgaagaattaaaggataaacttgctgaaggaaagcttgaaaaagccgatacggaagcagctcgtccgaaagaagtaacaatctatgctccagcagatggtaaattaatgaatatgtcttcggtaattgatgaggacggtcgtccttttccaggtaagggatttgcaattaagccaagtacaggtaaaatttatgcaccatttgatggtgagattaaatttacttttggtacaaagcatgcatttgaaattatttcaaatgatggcttacaagtaatcgttcatgttggtctgggaacagttaacttgcgtggacaaggatttgaaacttattatgacgatgggcaacacgttaagaagggtgacttgttactagaatttgatcgagacttagcactgaataatggatataaagacacaatagttacgttctatacgcagcctcgtcgaattcaggagactagtgaaattcaagccggtacaactgttgagcacggtgaaaaagttgtagaagttaaatttaga

SEQ ID NO: 176 - protein, 639 aa, Lactobacillus acidophilus
MANGHKTSGKQIISYASFCLGNLGHAAFYGVMSTYFIIFITSGMFSGLEQSVADKLIGLITGLMVLIRIVELVIDPILGNIVDNTKTKWGKFKPWIFIGTMVSAVLLLILFTGIFGLAQSNWILFAILFVIIYIGFDVFYSLSDVSYWGMVPALSEDSHERGIYTSLGAFSGAIGWNGLAIIVVPLVTGVTYAVTGKNEEGAPGWLAFAAVISALAIICAIIVCFGTKEKHNLIRNSAKQKTTLRQVFSAIFHNDQILWPSLAYLVFSLANTITNGVLFYLYKFVIGKPGEFWVVGLIATIIGFCVSPMFPILNKYIPRKWLFIAGQTCMICAYLLFIFCRDNVVLMDLGLILFNINFAQLVTVLTLTDAIEYGQLKSGQRNEAVVLAVRPMIDKFTGAVSNALVGYVAIAAGMTGTATAADMTAHDISTFNTMALYIPLVLPAISIVVFMTKVNLSEKKHAQVVEELKDKLAEGKLEKADTEAARPKEVTIYAPADGKLMNMSSVIDEDGRPFPGKGFAIKPSTGKIYAPFDGEIKFTFGTKHAFEIISNDGLQVIVHVGLGTVNLRGQGFETYYDDGQHVKKGDLLLEFDRDLALNNGYKDTIVTFYTQPRRIQETSEIQAGTTVEHGEKVVEVKFR

SEQ ID NO: 177 - DNA, 264 bp, Lactobacillus acidophilus
  CDS (1)...(264)
  misc_feature (0)...(0): ORF 639; ptsH
atggaaaaacgtgattttcatattattgcagaaacaggtattcatgcacgtccagctactcttttagtacaagctgcttcaaagtttggttcagacattaacttggaatacaatggtaagtcagtaaacttaaagtcaatcatgggtgttatgtcacttggtgttggtcaaaacgctgacgttactatcactgctgaaggtgacgacgaaaaagacgcattagacgcaattgcagacactatgaaaaaagaaggtttagctgaa

SEQ ID NO: 178 - protein, 88 aa, Lactobacillus acidophilus
MEKRDFHIIAETGIHARPATLLVQAASKFGSDINLEYNGKSVNLKSIMGVMSLGVGQNADVTITAEGDDEKDALDAIADTMKKEGLAE

SEQ ID NO: 179 - DNA, 1731 bp, Lactobacillus acidophilus
  CDS (1)...(1731)
  misc_feature (0)...(0): ORF 640; ptsI
atgaccaagactttaaaaggaattgctgctagtgatggtattgccattgctccagcatatcttcttgtggagcctgatctttcattctcaaagtcttcagtcgacgacattgatgctgaagtagcacgttataacgatgctattaaggaatcaactgccgaagttgaaaaaattcgtgatattgctaagaagagcttgggtgaagaagaatcccaagtttttgaagcacacttaatgattttgaacgatccagaatttactggtgcaattgagaatgaaattaaggattcaaagattaatgcagaagctgcccttgatgaaactgcacaaaagtttattgctatttttgaagggatgactgataatccttatatgcaagaacgtgcagctgatgtacgtgatgtttcaaagcgtattatggctcacttacttggtaaagaattaccaaacccagcttcaattgatcacgaagttattgttgtagcacatgacttgactccaagtgatactgcacaacttaacaagaaatacgttaaaggctttattactgatgttggtggtcgtaccgctcactcagcaattatggctcgttcacttgaattgccagctgttgttggtactgattcaatcaccaaagacgttaaaaacggcgacatgttaattgatgacggtcttgacggtgtagctattatttcaccaagtgaagaacaaatagctgactacaagaaaaagggtgaagacttccttaagcaaaaggctgaatggaagaagttaaaggatgaaccatcagtaactgcagatggtaagcaatttattattgctgcaaacatcggtactcctaacgatatgccaggtgtacatgaaaacggtgctgaagctattggtttgtacagaactgaatttttgtacatggattcatcagacttcccaactgaagatgatcaattcgaagcctacaagaaagttattgaaggtatgaacggcaagcaagttgttatcagaactatggatattggtggtgataagcaccttgattactgggatttaccagaagaaatgaatccattcttaggtgtacgtgctattcgtctttcacttatgaatgaagaaattttccgtacccaattaagagccttactccgtgcttccgcatatggtaagcttggtattatgttcccaatggttggtacattagctgaacttcgtaaggctaaggctattttaaacgatgaaaagcaaaaacttgttgaaaagggagttaagatcggtgacaacttacaagttggtatgatgatcgaagttcctgctgcagctgttttggctgatcaatttgctaaagaagttgatttcttctcaatcggtactaatgacttgatccaatatactatggctgctgaccgtggtaatgataacgtatcatacttgtaccaaccatataacccatcagtacttcgtttgattaagcacactattgatgctgctcatgaaaatggtatttggtgtggtatgtgtggtgaagctgctggtgataacaccatgttcccaattttactttcaatgggacttgatgaatactcaatgagcgcaacttcaatcttacgtattagaagcttaatgaagaagcttgataccaaagatcttaaggaattagctaatgaagcttgttttgtttcagaaactgctgaagaaaacgaaaaattagttaacgacttaatgaagaaaattaacaag

SEQ ID NO: 180 - protein, 577 aa, Lactobacillus acidophilus
MTKTLKGIAASDGIAIAPAYLLVEPDLSFSKSSVDDIDAEVARYNDAIKESTAEVEKIRDIAKKSLGEEESQVFEAHLMILNDPEFTGAIENEIKDSKINAEAALDETAQKFIAIFEGMTDNPYMQERAADVRDVSKRIMAHLLGKELPNPASIDHEVIVVAHDLTPSDTAQLNKKYVKGFITDVGGRTAHSAIMARSLELPAVVGTDSITKDVKNGDMLIDDGLDGVAIISPSEEQIADYKKKGEDFLKQKAEWKKLKDEPSVTADGKQFIIAANIGTPNDMPGVHENGAEAIGLYRTEFLYMDSSDFPTEDDQFEAYKKVIEGMNGKQVVIRTMDIGGDKHLDYWDLPEEMNPFLGVRAIRLSLMNEEIFRTQLRALLRASAYGKLGIMFPMVGTLAELRKAKAILNDEKQKLVEKGVKIGDNLQVGMMIEVPAAAVLADQFAKEVDFFSIGTNDLIQYTMAADRGNDNVSYLYQPYNPSVLRLIKHTIDAAHENGIWCGMCGEAAGDNTMFPILLSMGLDEYSMSATSILRIRSLMKKLDTKDLKELANEACFVSETAEENEKLVNDLMKKINK

SEQ ID NO: 181 - DNA, 999 bp, Lactobacillus acidophilus
  CDS (1)...(999)
  misc_feature (0)...(0): ORF 431; ccpA
atgcataagcaagaagttacgatctatgatgtagctcgagaagcaaaggtttcaatggcaaccgtttctcgtgtcgttaatggaaataataatgttagaaaagaaacacgtgatcgtgttttagaagttattaagagattacactatcaaccaaatgcggtagcacaaggtttggcttctaaacgtacaactactgttggtttgattgtcccagatttaactaatttatattttgcggaattatctaaaggaattgatgatattgcacttttatacaagtacaacatcattattacaagtattgaaaatcgcttgatgaaagaagatcaagttattcagagtttgcttaacaagcaggttgatggcgtaatttatatgtcaaaccgtttgccagataaagcagcagaagcattcaatcgaacagatactccagttgttttagctggtaccaaagacaatcgtgaagaatttgcttctgttacaattgattacaaaaaagcagatacagaagctttgaatttgatgatgcatgatggcaagaagaatttagcaattgttgttggagatgaagacgcagttgttaacggtgaaaatagaattcctgcttatcaagaatttattaaagaaaataatttaggtgagccacatatttatacaggaataagagattattcagatggttataatttatacccacaacttgttaaagatggaattgatggtgtaattgttactcgcgacatttcatccgttggtattatgaattccgcaatggatgctggtaagaagattccagaagatttggaaatcgtgactgctagtgcaactcagcttgcttcagttgttcgtccagctttaactacaattaagcaaccactatatgatatgggagctgttgcaatgagaatgttgactaagctgatgaacaatgaagaagttgatgaaactcacattgaattgccatatgaattagtcaaaaagcaaagtactgcaaataga

SEQ ID NO: 182 - protein, 333 aa, Lactobacillus acidophilus
MHKQEVTIYDVAREAKVSMATVSRVVNGNNNVRKETRDRVLEVIKRLHYQPNAVAQGLASKRTTTVGLIVPDLTNLYFAELSKGIDDIALLYKYNIIITSIENRLMKEDQVIQSLLNKQVDGVIYMSNRLPDKAAEAFNRTDTPVVLAGTKDNREEFASVTIDYKKADTEALNLMMHDGKKNLAIVVGDEDAVVNGENRIPAYQEFIKENNLGEPHIYTGIRDYSDGYNLYPQLVKDGIDGVIVTRDISSVGIMNSAMDAGKKIPEDLEIVTASATQLASVVRPALTTIKQPLYDMGAVAMRMLTKLMNNEEVDETHIELPYELVKKQSTANR

SEQ ID NO: 183 - DNA, 966 bp, Lactobacillus acidophilus
  CDS (1)...(966)
  misc_feature (0)...(0): ORF 676; ptsK
atggctgatgaagtaaaattaagtaaattaattaaggataataagagtattcttgaagtttatcaaggacaagaatatgttaatgctaaaaaaatctatgtttcagatatttatcgtccggggctagaattaacaggatattttgatttttatcctgcacaacgtattcagttgttaggaagaactgaaatttcgtatgcagctagacttgatcatgagattagaactcatgtatttactaagatggctactaaagctaccccatgttttttaatttcacgttcgctaccagtacctgaagaattatccgaagcagcagaaaaagcaaatattcctattctacgtactagtgaatctactacttatatttctagtattctaactgaatatttgcgagcacgattagcaaagagaaatagtattcacggtgttttggttgaaattaaaggtatgggtgtactgttaactggtgcttctggtgtaggtaaatctgaaacagcacttggtttagttcaaagaggtcatagacttattgctgatgatcgtgtcgatgtttttcaaaaagatcataatacagttgtaggtgaagcacccaaaattctaagacacttaatggaaattagaggaattggaattatcgatgtcatgaatttgtttggcgcaggtgcagttaaaagcagaaccgaaattcaattagtaataaatttggttaactgggatcctaaagcaaattatgatcgtctaggttttcaagaaaatactcgcgaaatatgtaatgttgaaattccacaggttaatattccagttaaagttggtcgaaatattgaaattattattgaagtagctgctatgaactttagagctaaaaaaatgggatatgatgctactcaaatgtttgataataatttaactaacttaatttcagaacactcaaaagaagatacagataaggtgcaacatgatgac

SEQ ID NO: 184 - protein, 322 aa, Lactobacillus acidophilus
MADEVKLSKLIKDNKSILEVYQGQEYVNAKKIYVSDIYRPGLELTGYFDFYPAQRIQLLGRTEISYAARLDHEIRTHVFTKMATKATPCFLISRSLPVPEELSEAAEKANIPILRTSESTTYISSILTEYLRARLAKRNSIHGVLVEIKGMGVLLTGASGVGKSETALGLVQRGHRLIADDRVDVFQKDHNTVVGEAPKILRHLMEIRGIGIIDVMNLFGAGAVKSRTEIQLVINLVNWDPKANYDRLGFQENTREICNVEIPQVNIPVKVGRNIEIIIEVAAMNFRAKKMGYDATQMFDNNLTNLISEHSKEDTDKVQHDD

SEQ ID NO: 185 - DNA, 912 bp, Lactobacillus acidophilus
  CDS (1)...(912)
  misc_feature (0)...(0): ORF 1778; FruK
atgatttatacagtaactgttaacccagctcttgactatgttcttcaattagaaaaagttaaccgcggggaagttaacagaactaacaatgattcatttttagcagggggtaaaggaattaacgtttctcaaatccttaaccaattaaatgttgacaacactgcatggggctttgttggcggctttaccggtaaggaattggttcgtcaattaaaccaaaagagaattgaaagtgacttcgttactatttcagataatactcgtgtgaacgttaagatccatgcagaaaaggaaactgaaattaatgcagcaggtcctgccattactaaccaagaaatcgttgctttcaaagatcgcttgaacgacttgaagaagggcgacatcgtagtaatgagcggttcacttactccaagtcttcctactgatttctaccaatcacttcttccaactattaaggaagctggtgcagaatttgtagttgatactactggtcaagcacttcttgatactttggaatatcacccattagtaattaagcctaaccatcacgaattggctgatttgtttggcgtaacatttgaatcaagtgatgacatgcttaagtacgcaaagaagcttcttgacatgggtgctcaaaatgtaatgatttcaatggctggcgaaggcggtttccttttgactaaggatcatgtatatcatgcaaagggtgctgtaggtactgctgttaactctgttggcgctggtgactcaatgattgctgggttcgttggtacttactacaagactcaagatccaaaagaaggatttagaattggtatggcctgtggtgctgctactgcatttactaaagatattgcggttaagagccaaatcgatgcagtattaccacaaattaaggttgaacaaatttct

SEQ ID NO: 186 - protein, 304 aa, Lactobacillus acidophilus
MIYTVTVNPALDYVLQLEKVNRGEVNRTNNDSFLAGGKGINVSQILNQLNVDNTAWGFVGGFTGKELVRQLNQKRIESDFVTISDNTRVNVKIHAEKETEINAAGPAITNQEIVAFKDRLNDLKKGDIVVMSGSLTPSLPTDFYQSLLPTIKEAGAEFVVDTTGQALLDTLEYHPLVIKPNHHELADLFGVTFESSDDMLKYAKKLLDMGAQNVMISMAGEGGFLLTKDHVYHAKGAVGTAVNSVGAGDSMIAGFVGTYYKTQDPKEGFRIGMACGAATAFTKDIAVKSQIDAVLPQIKVEQIS

SEQ ID NO: 187 - DNA, 753 bp, Lactobacillus acidophilus
  CDS (1)...(753)
  misc_feature (0)...(0): ORF 1779; FruR
atgctgacacaagaacgccaaagcttaattgaagactacgttaatcagcacgaattgtgccgcgttagcgaattatgcaatttaactgatacatctgaatcaactatccgacgtgatttgattcaaatggagaaaaatggcatcctcaagcgagttcatggcggtgctcaatcagtaaaaaatttctctcgtgatgtttcccaaaacgtccgctttagtctgaatcatgatgttaagattgctattgctaaatatgcggcagagcatttcgttcatccaggtgataatgtctttattgatgcaggaacgacaacctatgaaatggtcccatttctggcagaaattcctaatgttaagattatcaccaacggagttgaaactgctctttgcagcttgaatcatggcattaagactttcttaattggtggcgaggtcaaagatgatactcatgctgttgttggtcagactgctttaagtcagattagagcaatgaatttttcagctagctttgttggagctaatgggattgaaaagaatggcaacttaactacgccagatcctgaagaagctgcaattaaagcagctgagattaaacaagctagacatgcatatgttttagctgatagtactaaaattggcgaacgaaattttgctgtttttgctaatactgatgacgttattgtggtaacagaaaagattaaatccagtcaaaaaacggcattacctgccgatataaatctagaggaggcaaaa

SEQ ID NO: 188 - protein, 251 aa, Lactobacillus acidophilus
MLTQERQSLIEDYVNQHELCRVSELCNLTDTSESTIRRDLIQMEKNGILKRVHGGAQSVKNFSRDVSQNVRFSLNHDVKIAIAKYAAEHFVHPGDNVFIDAGTTTYEMVPFLAEIPNVKIITNGVETALCSLNHGIKTFLIGGEVKDDTHAVVGQTALSQIRAMNFSASFVGANGIEKNGNLTTPDPEEAAIKAAEIKQARHAYVLADSTKIGERNFAVFANTDDVIVVTEKIKSSQKTALPADINLEEAK

SEQ ID NO: 189 - DNA, 993 bp, Lactobacillus acidophilus
  CDS (1)...(993)
  misc_feature (0)...(0): ORF 1433; dihydroxyacetone kinase
atgaaaaagataattaatgatccacataatgttgttcccgaaatggtcatgggaatgactcgttcttatcctcaatttattgaaaaaattcctgacacagaagctgtcgtaagagccgataaagattctatgaaaggaaaagttggtattgtcagtggtggtggttcaggtcatgaaccaacccacgcaggctatgttggtaaaggaatgcttagcgccgctgtttgcggtcaagtctttacttctcctactccagatcaaatttatgctgcaattaaggcagtagatcaaggaaaaggcgtttttctggtagttaaaaattattctggcgatgtaatgaactttgatatggctaaagatttagcggaaatggaagatattcctgttaagtcaatcgttgttgacgatgacattgctgtagaaaatagcctttacactcaaggacgtcgcggagtagcaggaactttatttatgcataaaattttaggtgctgcagctcaagaaggcgcaagcctagatgaacttgaaaagttagctaaaaaagttttgccaaatattaagactcttgccgttgccttatctgcagcaactaacccagaagttggtaagcccggttttcttctaaaagaagatgaaattgaatatggtgttggtattcatagtgaaccaggttatcgccgcgaaaagattaagccttctaaggaattagttgaagaattaattggtaagttaaacgacgaaatgaatttagatggcaataaaaaatatgcttgtctcattaacgggatgggcgcaactccattgatggaacaatatgtttttgctaacgacgttttaaataaacttgaagaatttaacattaagcctagctttatgaaggtcggcaactatatgacttcaatcgatatggccggtatttccttaactctttttgaaattaaagaagacaaatggctagactatctaaattaccctgttcaaacaattgcatgg

SEQ ID NO: 190 - protein, 331 aa, Lactobacillus acidophilus
MKKIINDPHNVVPEMVMGMTRSYPQFIEKIPDTEAVVRADKDSMKGKVGIVSGGGSGHEPTHAGYVGKGMLSAAVCGQVFTSPTPDQIYAAIKAVDQGKGVFLVVKNYSGDVMNFDMAKDLAEMEDIPVKSIVVDDDIAVENSLYTQGRRGVAGTLFMHKILGAAAQEGASLDELEKLAKKVLPNIKTLAVALSAATNPEVGKPGFLLKEDEIEYGVGIHSEPGYRREKIKPSKELVEELIGKLNDEMNLDGNKKYACLINGMGATPLMEQYVFANDVLNKLEEFNIKPSFMKVGNYMTSIDMAGISLTLFEIKEDKWLDYLNYPVQTIAW

SEQ ID NO: 191 - DNA, 582 bp, Lactobacillus acidophilus
  CDS (1)...(582)
  misc_feature (0)...(0): ORF 1434; dihydroxyacetone kinase
atgactttaactgttgatacattaacaacttggatgaataattttgcggataaagttgaaacaaataagcaatatttaagtgatctggatacgccaattggtgatggtgatcacggttttaacatgagtcgcgggatgcaagctgttaaagaaaaattagctactaaaccagccgatgttccaagtgcattaaaaacaattgctatggcacttatttctactgtaggtggagcttctggtcctttatatggaactgcctttttagaaatggctaaaaagagtagctcaactgataatgtaggtgaattacttgatgctgcacttgctgggatccaaaaacgtggcggtgcagaacccggcgataagacaatggttgacgtttggtataagttggttcctgatataaaagatggcagtctatccgaagataaaatcaaagatgctgttgaagcaactaaagatatgattgccaaaaaaggtcgtgcaagttacttaggtgaacgttctaaaggtcatatcgacccaggttctgaatcaagcggctatctttttgagacgctgcttgaaacggagggtttatta

SEQ ID NO: 192 - protein, 194 aa, Lactobacillus acidophilus
MTLTVDTLTTWMNNFADKVETNKQYLSDLDTPIGDGDHGFNMSRGMQAVKEKLATKPADVPSALKTIAMALISTVGGASGPLYGTAFLEMAKKSSSTDNVGELLDAALAGIQKRGGAEPGDKTMVDVWYKLVPDIKDGSLSEDKIKDAVEATKDMIAKKGRASYLGERSKGHIDPGSESSGYLFETLLETEGLL

SEQ ID NO: 193 - DNA, 705 bp, Lactobacillus acidophilus
  CDS (1)...(705)
  misc_feature (0)...(0): ORF 1436; glycerol uptake facilitator
atgtcaggtttcattggtgagttcctaggaactatggtattaatcgttttaggaaccggatgtggcgcagcgattaacttgaataaatcctacgccaaaggttcccactggctatacgtaaccattgcttggggtatggccgttacatttggtgtttatgttgctgcaaactttggctcacaaggtcacttaaatccagctgtcacaattgggtttgcggctttcggatttttcccttggagcggagtcttaccttatttattaggtcagtttttaggtgcttttgtcggtgcagtacttgtaattattcaatactaccctcactttaaagcaaccaaaactaccgaagaaggtaatcaagtaggtattttcgctacagcaccggctattaagaataatttattcaacttcctaagtgaaacaatcgcaacatttatttttatctttgctttacttaacttaggtgattttgataaaggtcttaagccattaattgttggtttattgattatggtagttggacaaggtctaggtgctactactggatttgctttaaaccccgctcgtgattggtcaccaagacttgcttatacaatcttgcctgtaccgaataaatcaagtgctaattggcaatacgcatgggtaccaatgtgtggtcctatcgttggtggtcttttagcttcagcattacaatacttcttaaaa

SEQ ID NO: 194 - protein, 235 aa, Lactobacillus acidophilus
MSGFIGEFLGTMVLIVLGTGCGAAINLNKSYAKGSHWLYVTIAWGMAVTFGVYVAANFGSQGHLNPAVTIGFAAFGFFPWSGVLPYLLGQFLGAFVGAVLVIIQYYPHFKATKTTEEGNQVGIFATAPAIKNNLFNFLSETIATFIFIFALLNLGDFDKGLKPLIVGLLIMVVGQGLGATTGFALNPARDWSPRLAYTILPVPNKSSANWQYAWVPMCGPIVGGLLASALQYFLK

SEQ ID NO: 195 - DNA, 1440 bp, Lactobacillus acidophilus
  CDS (1)...(1440)
  misc_feature (0)...(0): ORF 1437; gtfAII
atgccaattgaaaataaagtaatgttaattacttatccagacagtttgggtaaaaatttaaaagaattagatgaaattttaagtgaagacttgaagggggctgtaggcggtattcacttattgccattcttcccatcaactggtgaccgtggatttgctccgactggatatacagaagtagatcctaagtttggtgattggtcagacattgaaaaaataggtaagaaatattatttgatgtttgattttatgattaatcatatttctcgtcaatcaaaattttataaagatttcaaacaaaagaaagataaaagtaagtatgccgatttatttttgagctgggacaaattttggccggaaggtcgtccaactcgaaaagatattgatttaatttataaacgaaaagatcgtgctccatatcaagaaattacttttacagatggcagtaaagaaaaattatggaatacttttggtgaagagcaaatcgatatggatgttcgaaaggaggtgacacagaagtttattaaagatacgttgagagcattaattgatcatggtgctgatattattcggttagatgcttttgcgtatgctgtaaagaagttagatactaatgatttctttgtagagccagaaatttgggatttactaaaacaagtacaagatgatatttctgataaaggtgcaatgattctaccagaaatacatgaacactattcaatgccatttaagatttcaaagcatggatattatatctatgactttgctttaccaatggtaactttatattcactttattcaggtaagtccaatcgcttagctgattggcttaagaaatgtccaatgaaacagttcactaccttagatacacatgatggtatcggtgttgttgatgctcgtgatattctctcccctgacgaaattaaatacacaagtaatgaattgtataaagttggagctaatgttaaaaagaaatattctagtgccgaatatcataatttagatatctaccaaattaatacaacttattattctgctttaggcaatgatgataaaaaatactttattgcgagacttattcaaatgtttgcgcctggtattccgcaagtctattatgtaggaatgctggctggtaaaaacgatatcgaactcctcgaaaagactaaagaaggtagaaacattaatcgtcattactatggcagagaagaagtagctgaagaaactaaaagacctttagtagcagcactcttgaaattgtttaattttagaaacaatgaagcagcttttgatcttgatggatccattgaaatcactacgcctaatgaaaacgtgattcaaataactcgtatgaataaagataaaactcgaaaagcaagagctgttattaatttaaaaaatttaacttatcaagtgactgtaaataatgaggttattaacttt

SEQ ID NO: 196 - protein, 480 aa, Lactobacillus acidophilus
MPIENKVMLITYPDSLGKNLKELDEILSEDLKGAVGGIHLLPFFPSTGDRGFAPTGYTEVDPKFGDWSDIEKIGKKYYLMFDFMINHISRQSKFYKDFKQKKDKSKYADLFLSWDKFWPEGRPTRKDIDLIYKRKDRAPYQEITFTDGSKEKLWNTFGEEQIDMDVRKEVTQKFIKDTLRALIDHGADIIRLDAFAYAVKKLDTNDFFVEPEIWDLLKQVQDDISDKGAMILPEIHEHYSMPFKISKHGYYIYDFALPMVTLYSLYSGKSNRLADWLKKCPMKQFTTLDTHDGIGVVDARDILSPDEIKYTSNELYKVGANVKKKYSSAEYHNLDIYQINTTYYSALGNDDKKYFIARLIQMFAPGIPQVYYVGMLAGKNDIELLEKTKEGRNINRHYYGREEVAEETKRPLVAALLKLFNFRNNEAAFDLDGSIEITTPNENVIQITRMNKDKTRKARAVINLKNLTYQVTVNNEVINF

SEQ ID NO: 197 - DNA, 2196 bp, Lactobacillus acidophilus
  CDS (1)...(2196)
  misc_feature (0)...(0): ORF 1438; melA
atgaccagtaacttaattaaatttgatgatcaaaataaagtatttcatttacataacaagcaaatatcatatttgctttctattgaagatggtggcacattaagtcatttatactttggtggagctgttaaaaattacaataatcaattaaagtatcctagattagaccgcggattttcaggaaatttgcctgaatcgcttgatcgtacattttcacgtgattcacttccaaaagaatatagtagtgctggtgaaatggactttcatactcctgctacaatagtacgtaatccagatggctcaaatgctttgtttttagcttataagtcatacaaaatcgaagatggtaagccagatttaaagggattaccacactcttggacaaaagaagatgacgaagcgcaaacgttaatagttactcttgaagataaggtaagcaagctagaatatgacttattatatacaatttatcgagatcgtcctgtaattgtacgttcagttcaagttcataatcatggtgaagaagcagtatatctcgaaaaagttgcttctatgcaaatggattatgtagataaggattttgaagtcattactttaccgggtgctcatgcaaatgagaggcgtgtgcaaagagaaaatattggtcaaggaattaaagtgttttctagttatcgtggcacatcaagtcaccaaatgaatcctttcatggcattagtagatcatgataccaatgaatttatgggtgaagcttatggttttgcactagcatattccggtaatcataaatttgaagttgaacgtgatcaatttggtcaaatccacgtgaataccggaattaatgattacaattttaaatggaaattgaatccaaatgaagaatttcaaactccagaagttttgatggtttattctgatcaaggattaaataaaatgagtcaggcatttcatagcttgatccatgaacgtattatgcgtagtaaatttaaggatcaaattagacctgttctggttaacaactgggaagcaacttattttgatttcaatgaagataaattaaaaactattgtcgataaggctaagaaattaggcctagaaatgtttgtcttagatgatggttggtttggtcatcgtgacgatgacaacagttctttaggagattggaaagtttataagaagaagtttcctaatggattaggacattttgcagattatgttcatgaacaaggattaaagtttggactatggtttgaaccagaaatgatctcatatgaatcaaatctatataaagaacatccagattatttaatgcatgtacctggtagaaagccgtgtccgtcaagaaatcaatatgtcctagaacttggtcgtaaagaagttcgtgataatatctttgagcagatggtaaaaatcctagatagtaaaaagattgattatattaaatgggatatgaaccgtagtttgtctgatatttatgaatcggatttacctgctgatcaacaaggagaagcatatcatcgttatgtattaggttattacgatttattaaataaattggtaactagatatcctgatattttatttgaaggatgctctggtggtggcggtagatttgatgtcggacaagcttattacacaccacaaatttgggctagtgacaatactgatgctattgaaagattaaagattcaatacggtactagccttgtttatccgcaatcaatgatgacatcacatgtttcagtatcacctaatgaacagaatggaagaattactccatttaatacacgtggggctgtagcaatgtggggcgacttaggctatgaacttgatttaaccaagatgagtgatgaagaaagtgatcaagttgttaaacaagtcacagaatataagaaaattagagaagttacccagtttggtacgctttatcgtttaaaggcttcagcaagcaatcaatgtgcatggatgatggttgattctaataagaatgaagcagttgtaactgtcgtcaatgtaatggctcacgctcaaccatattgtacgaagacaaaattagctggtcttgatccagataaacgatacaagaatttagaaactgatgaagtttttggtggcgacgagctaatgcaccttggcttttatgatcctattgaacgtggtgattttaaagccaaaatgtatcattttaaggctatcaat

SEQ ID NO: 198 - protein, 732 aa, Lactobacillus acidophilus
MTSNLIKFDDQNKVFHLHNKQISYLLSIEDGGTLSHLYFGGAVKNYNNQLKYPRLDRGFSGNLPESLDRTFSRDSLPKEYSSAGEMDFHTPATIVRNPDGSNALFLAYKSYKIEDGKPDLKGLPHSWTKEDDEAQTLIVTLEDKVSKLEYDLLYTIYRDRPVIVRSVQVHNHGEEAVYLEKVASMQMDYVDKDFEVITLPGAHANERRVQRENIGQGIKVFSSYRGTSSHQMNPFMALVDHDTNEFMGEAYGFALAYSGNHKFEVERDQFGQIHVNTGINDYNFKWKLNPNEEFQTPEVLMVYSDQGLNKMSQAFHSLIHERIMRSKFKDQIRPVLVNNWEATYFDFNEDKLKTIVDKAKKLGLEMFVLDDGWFGHRDDDNSSLGDWKVYKKKFPNGLGHFADYVHEQGLKFGLWFEPEMISYESNLYKEHPDYLMHVPGRKPCPSRNQYVLELGRKEVRDNIFEQMVKILDSKKIDYIKWDMNRSLSDIYESDLPADQQGEAYHRYVLGYYDLLNKLVTRYPDILFEGCSGGGGRFDVGQAYYTPQIWASDNTDAIERLKIQYGTSLVYPQSMMTSHVSVSPNEQNGRITPFNTRGAVAMWGDLGYELDLTKMSDEESDQVVKQVTEYKKIREVTQFGTLYRLKASASNQCAWMMVDSNKNEAVVTVVNVMAHAQPYCTKTKLAGLDPDKRYKNLETDEVFGGDELMHLGFYDPIERGDFKAKMYHFKAIN

SEQ ID NO: 199 - DNA, 984 bp, Lactobacillus acidophilus
  CDS (1)...(984)
  misc_feature (0)...(0): ORF 1457; GalM
atgaaaactaattttgtaaaatatgaacgcaaagataataaagatctttgtgaaattacacttgaaaatgatgctggaatggctgttaaagtcctaaattatggagctacgctagaaaaagtattacttgatggtgaaaatatgattctgtcacttaattcgccagaagattattctaaagagcggaattttttgggcggcacagttggtagaattgctggtcgcgttcgtgctggacaatggaagcatggcaatgaaatacatcaattgccattgaatgatggtgataatcatattcacggtggtattggtacagatatgcacgtgtgggattttagaccgtcttgcgatagtgaacatgctagagtagatctaactttatttgatccagatggaaataatgattatccaggtaatttaaagctacatgctagatatgaattagataatgagaataatttgcattatctgcttgaagcagttagtgataagttgacaatttttaatctggttaaccacacttactttaatttgggtgagcgtgctgaagatttgaatttacagatgaatgcggattattatttgccagttgatgaagcaggcttgcctgatcgcggaatggccgaagtagctggaactgcttttgattttagaaagactaagcgaattggggatgcacttaatagtgatgactcacagattaaattgcgcaatggacttgatcatccatttattttgaatggtaacaaccctgctgcgctattgagttctaataaacatcgtcttattgtaaaaactaatgcaccagcgttggttctttatgcaggaaatcattttaaccatacaggtatcgtaaataacattggtcaatatgatggaattacttttgaagcacaatgtccacctgcagaaggtaatgatttaggacaaattacgcttttaccatttgaaaaatttaagcgtactgttgattggaaatttgaa

SEQ ID NO: 200 - protein, 328 aa, Lactobacillus acidophilus
MKTNFVKYERKDNKDLCEITLENDAGMAVKVLNYGATLEKVLLDGENMILSLNSPEDYSKERNFLGGTVGRIAGRVRAGQWKHGNEIHQLPLNDGDNHIHGGIGTDMHVWDFRPSCDSEHARVDLTLFDPDGNNDYPGNLKLHARYELDNENNLHYLLEAVSDKLTIFNLVNHTYFNLGERAEDLNLQMNADYYLPVDEAGLPDRGMAEVAGTAFDFRKTKRIGDALNSDDSQIKLRNGLDHPFILNGNNPAALLSSNKHRLIVKTNAPALVLYAGNHFNHTGIVNNIGQYDGITFEAQCPPAEGNDLGQITLLPFEKFKRTVDWKFE

SEQ ID NO: 201 - DNA, 1461 bp, Lactobacillus acidophilus
  CDS (1)...(1461)
  misc_feature (0)...(0): ORF 1458; GalT
atgaaagttatcgaaaagtttgcagatcaagtagttaatagcggtgcgtatgaaccacttgatcgagtatacgtaattaataaaattcgcagtttggtaggtgatcatgatgaagaagaaaatgataagcctgcagttaaacaattagttgatattgctgtagaaaatgaaaaaatcccagatgatgtaacttcaaaagaagtgttgaatgatcaattatatgatctaatgacgccaactccttcgaagaccaataatattttctggcaaaaaatgcaaaactctcctaaaaaagctaccgattggttctatcagctctgcgtaaacgatgattatgtaaaagaagaagcaattgctaagaatgtagtcttttcgggaactagttccaaaggtcatggtttagaaattacgattaacttatctaaacctgaaaaagatcctaaggctattgctgcggcagctcatgctacaggaaagaagtatcctcaatgtgcactttgtcttgaaaatgaaggctacttaggtggctatggcaaaaatgccagaagtaatttgagaattatccgaatgagtattgcaggcagaccatggggctttcaatattcaccatatgcttactttaatgaacactgtatctttttagatcaagagcatatcccaatggaaattaatcaacaaacgttgattaatttggtagaaatcgaaaaaacattaccacagtatttcgttggctcaaatgcagatttaccaattgttggtggctcaatgctatcgcatgaacactatcaaggtggtcgtcatacattcccaatgatgaaggctaagattaagaaagacgtatcctttgatgcgtatcctgacgttaaagccggaattgttgattggccaatgagtgatttacgcttaagtagtgaaaattcgcttgatttaattgatttaggtagcaaaattatcagattctggaatcaatactctgaccccgctcgtgatattagagcatttactgacaatactcgtcatcacacagttactccaattatgcaccgtgaaggtaagaaatttattcttgatcttgttttacgtgataacaatacaagtgcagattatccgcttggtattttccacccacacaagcaattgtggcatattaaaaaggaaaatattggtttaattgaagtaatggggcgggcaattttgccaggtcgacttaaaagtgagcttgaagaagtaaagaaatattggctgggtgaagaaaataagatagccgacagtcataaagaatgggctgaccgaattaagtctgaagaaaatatctctcaagagaatgttgatcaagtgatgcaacaagctttggttgaagtattcgaacaagttttacaagatgccggtgtatttaagaataatgaagacggtgatcaaggctgggataaatttatttcagctttagttgaaaaagtggat

SEQ ID NO: 202 - protein, 487 aa, Lactobacillus acidophilus
MKVIEKFADQVVNSGAYEPLDRVYVINKIRSLVGDHDEEENDKPAVKQLVDIAVENEKIPDDVTSKEVLNDQLYDLMTPTPSKTNNIFWQKMQNSPKKATDWFYQLCVNDDYVKEEAIAKNVVFSGTSSKGHGLEITINLSKPEKDPKAIAAAAHATGKKYPQCALCLENEGYLGGYGKNARSNLRIIRMSIAGRPWGFQYSPYAYFNEHCIFLDQEHIPMEINQQTLINLVEIEKTLPQYFVGSNADLPIVGGSMLSHEHYQGGRHTFPMMKAKIKKDVSFDAYPDVKAGIVDWPMSDLRLSSENSLDLIDLGSKIIRFWNQYSDPARDIRAFTDNTRHHTVTPIMHREGKKFILDLVLRDNNTSADYPLGIFHPHKQLWHIKKENIGLIEVMGRAILPGRLKSELEEVKKYWLGEENKIADSHKEWADRIKSEENISQENVDQVMQQALVEVFEQVLQDAGVFKNNEDGDQGWDKFISALVEKVD

SEQ ID NO: 203 - DNA, 1161 bp, Lactobacillus acidophilus
  CDS (1)...(1161)
  misc_feature (0)...(0): ORF 1459; GalK
atgaataaagaagaacttctcactgaatacgaaaaaacatttaatgaaaacggccaagacgtctttttctcacctggaagaattaatgtaattggtgaacatactgactataatggtggtcatgtttttccagctgcaattagcttgggtgtctatggtgtatatggaccaagagatgatacgaaggtccgcttatattctggcgatgttgacggtgatgttgttgagtttgatatcaatgatacaactgttgaaaaagatgaccgcttctgggcaaattacttcaagggaatgatcacttacttacgtgaaaagtacgacaacatcaaccacggctttaacttatatatcaaagctaacttgccatctggttctggtctttcgtcaagtgcagctattgaaatgctcatgggtatcattcttaaagacgaatttaacctcgatgttgatcgcattgcattagctaaaatgggacaaagaactgaaaatgaatttgtaggcttgaactcaggtatcatggatcaattcgcctgcattatgggtaaaaaggatagtgcaattttccttgactgtaatactttggaatatgaatataagccacttgccttaggcgattatgagatcatcattatggccactaacaagccacatactttagctgattccgcatataatgatcgtgttcgtgaatgtcatgatgcacttgaaaaattacaacaaaagcttgatgttaagtcattgggtgaacttgataatgatactttagatgaatattcttatcttattaatgatgaaactgaattaaaacgcgctcgtcatgctgtaagtgaaaaccaaagaactttgcgtgctactaaggctatgcaagatggtgatttagaaaaacttggtcgcttgatcgatgcttctcacgtctcacttcattatgactacgaggtaactggtgatgaacttgacactttagctgaagcttcatggaagcagccaggagttttaggcgcaagaatgattggtggtggcttcggtggtagtgcaatcgctatcgtaaaaaagagtgaagctgaaaactttaagcagaatgtcggtaaaatttatcgtgacaagattggttatgatgctagtttttatgatgctgaaattgttgatggtactaagaaaatc

SEQ ID NO: 204 - protein, 387 aa, Lactobacillus acidophilus
MNKEELLTEYEKTFNENGQDVFFSPGRINVIGEHTDYNGGHVFPAAISLGVYGVYGPRDDTKVRLYSGDVDGDVVEFDINDTTVEKDDRFWANYFKGMITYLREKYDNINHGFNLYIKANLPSGSGLSSSAAIEMLMGIILKDEFNLDVDRIALAKMGQRTENEFVGLNSGIMDQFACIMGKKDSAIFLDCNTLEYEYKPLALGDYEIIIMATNKPHTLADSAYNDRVRECHDALEKLQQKLDVKSLGELDNDTLDEYSYLINDETELKRARHAVSENQRTLRATKAMQDGDLEKLGRLIDASHVSLHYDYEVTGDELDTLAEASWKQPGVLGARMIGGGFGGSAIAIVKKSEAENFKQNVGKIYRDKIGYDASFYDAEIVDGTKKI

SEQ ID NO: 205 - DNA, 1017 bp, Lactobacillus acidophilus
  CDS (1)...(1017)
  misc_feature (0)...(0): ORF 1460; surface protein
atgccacataaaaatacgaaatctaatgtacaaaaaattactgctagtgtagcttctgtgattgtaagtactggaattgtaatgaattcaagtaatcgtagagttaaagcaactggtaaacgagaagatgaaattgttgaagttgaaagtttgaagagagctgatactgaaacgacgaaggctgctgctgtgcaaactcctaaaataaaccaaactaaaaagatgagtcatcgtactcaaaaggttacacagatgattcactatgtagatgaagatgaaagaccggtttatgatgattacacggctagtttaatttttgaacaaacaggaattctggataatgttactggtaagcagacatggaatagcaattggttaccaaagactacggcaacttttagtgctgtagaacatcccgtggtaagaaatcatcatttagtaaatccagagataaatgaagtaagtgcgtatgatgttgaagtaacggatgatacttttaaaaatcctcttcttaaagttcataaagttgtatatgcacatgatatagaaccaattaaacggacgcaggtagtaacgcaaactattcattatagatatgaagatggggcggttgcacatgatgatcatgttgtgtcattaatatttacacagtcaggtaagagggatttgactaatggtaaagaaatttgggatagtaaatggtcgctgactcaaacttttgaagctttgcctagcccagttattattggatatacagcagataagccgatggttggtcctgatgaggttacggttgatagtaaaaatttccttgataaacaaaatagagaagaaaccgtaatttatagtgcgaatactattacgcaaaataagaaagatgggattagtgaagaaaagaatgtaaataattctgttgctgtcgcgccactaaaaagtgctgtaatgattggcggagtaatatctattttaaaatttaaaagattaatggttattataaaaaacaagaaggatcataaa

SEQ ID NO: 206 - protein, 339 aa, Lactobacillus acidophilus
MPHKNTKSNVQKITASVASVIVSTGIVMNSSNRRVKATGKREDEIVEVESLKRADTETTKAAAVQTPKINQTKKMSHRTQKVTQMIHYVDEDERPVYDDYTASLIFEQTGILDNVTGKQTWNSNWLPKTTATFSAVEHPVVRNHHLVNPEINEVSAYDVEVTDDTFKNPLLKVHKVVYAHDIEPIKRTQVVTQTIHYRYEDGAVAHDDHVVSLIFTQSGKRDLTNGKEIWDSKWSLTQTFEALPSPVIIGYTADKPMVGPDEVTVDSKNFLDKQNREETVIYSANTITQNKKDGISEEKNVNNSVAVAPLKSAVMIGGVISILKFKRLMVIIKNKKDHK

SEQ ID NO: 207 - DNA, 627 bp, Lactobacillus acidophilus
  CDS (1)...(627)
  misc_feature (0)...(0): ORF 1461
atggatattagaattgttaatactaaaaatagaattcaatcaggtttgatagtagcaataaacagcatgccgctatacaaaattaaagataaagatattattcaaaaagcacaggtatcgtcatctagttattacaaatattattctgataaaagtgaagtgttacgggatttagaaaattctttgttttctgaatttaggattgcattaagcatggatagtaaaaactgggggactgtaaatcatgcaccaagtaaaaaagacataagtagattgattgacagcaatattaatgaactaattaattattttaataaacataaggatatgttacagtcgcttatttctgaaaatggtgatccaggttttaaaaatcaaatagttggtgtaactaccaatactgttaaaaaattaattgtttactattttcatttgtacaatcaggaatatattttgaaaaaagataaattgaagttgacattacttgctagaagatacgcattatcttttttaggaccattgttcgcatggttagaatatacagacgagatgacattgaaagaaacaaagaaattgatgaaacaaatgattttgaattcaccatatgatatttcgactcatggattc

SEQ ID NO: 208 - protein, 209 aa, Lactobacillus acidophilus
MDIRIVNTKNRIQSGLIVAINSMPLYKIKDKDIIQKAQVSSSSYYKYYSDKSEVLRDLENSLFSEFRIALSMDSKNWGTVNHAPSKKDISRLIDSNINELINYFNKHKDMLQSLISENGDPGFKNQIVGVTTNTVKKLIVYYFHLYNQEYILKKDKLKLTLLARRYALSFLGPLFAWLEYTDEMTLKETKKLMKQMILNSPYDISTHGF

SEQ ID NO: 209 - DNA, 2001 bp, Lactobacillus acidophilus
  CDS (1)...(2001)
  misc_feature (0)...(0): ORF 1462; LacZ
atgacacaattatcacgttttctttatggtggtgattataatcctgaccaatggccagaagaaacatggtcgaaagatattcacgtatttaaaaaggcggatattaattcggcaacgattaacattttttcttgggcattgcttgaaccaagagaaggaaaatataatttctcaaaattagataaagttgtacaacaattatctgatgctaactttgatattgtgatgggaacagccacagcagcgatgccagcttggatgtttaaaaaatatcccgatattgccagagtagattatcaagacagacgtcatgtatttggtcagcggcataacttctgtcctaatagctcaaattatcaaagattagctggtgaattagtaaagcagttagttgaacgctacaaggataataagcatatcgtagtttggcacataaacaatgaatatggtggcaactgttattgtgagaattgtcaaaacgcttttagaaaatggttgaagaataaatataagaccgttgaaggtcttaacaaggcatggaatatgaatgtatggagccatacgatttatgactgggatgaaattgttgttcctaatgagttaggggatgtatggggaatagaaggtagtgaaactattgtagctggtctttcaattgattatctgcgttttcaatctgaaagtatgcaaaatcttttcaagatggaaaagaagattattaaaaaatatgatccggaaactcctgtaacgactaatttccatggtttgcctaacaagatggttgattatcaaaagtgggcaaaaggtcaagatattatttcatatgatagttatccaacttatgatgctcctgcatataaagcggcattcttgtatgacttaatgcgaagcttgaaacatcagccatttatgttaatggaatctgcgccttcacaagttaactggcaaccatatagtccgcttaagcggcctggacaaatggaagcaactgaatttcaagctgtagcccatggtgctgatacggtacaattcttccaattaaaacaagcagttggtggctccgaaaaattccacagtgcagttattgctcattcgcaaagaaccgatactagagtatttaaagaactagctgatttagggaagaaattaaagaatgctggaccaacgattttagggtcaaagactaaggcaaaggtcgcaattgtctttgattggagtaacttctggtcgtatgagtatgtggacggaattactcaagatttgaactatgtagattctattcttgattactaccgtcagttctatgaacgcaatattccaactgacatcattggtgtagacgatgactttagcaactatgatttggttgtagcgcctgtgctttatatggttaaacatggtcttgataagaagatcaacgactatgttgaaaacggtggtaactttgtcactacttatatgtcaggcatggtgaactcatcagataatgtatatcttggtggctatcctggtccattgaaggaagttacaggcatttgggttgaagaaagtgatgcagtagtcccaggacaaaagattaaggtcttaatgaatggtaaggattatgatactggtctgatctgtaacttgattcatccaaatgacgctaagattttggcaacttatgcgagtgaattttatgcaggtacgccagctgttaccgaaaatcaatatggcaaaggtagggcttggtatattggtacaaggcttgaacatcaagggttaactcaattattcaatcatattatttttgaaacgggtgttgaatcactggtttgcgatagtcataaactagaaataactaagcgtgttactgaagatggtaaggaactttactttgtgcttaatatgagtaatgaagaaagaacgttaccaagcaagttcacaggttatgaagatattttaactggtgaaaaagctcataaagatatgaaaggttgggatgttcaagtattgagaaat

SEQ ID NO: 210 - protein, 667 aa, Lactobacillus acidophilus
MTQLSRFLYGGDYNPDQWPEETWSKDIHVFKKADINSATINIFSWALLEPREGKYNFSKLDKVVQQLSDANFDIVMGTATAAMPAWMFKKYPDIARVDYQDRRHVFGQRHNFCPNSSNYQRLAGELVKQLVERYKDNKHIVVWHINNEYGGNCYCENCQNAFRKWLKNKYKTVEGLNKAWNMNVWSHTIYDWDEIVVPNELGDVWGIEGSETIVAGLSIDYLRFQSESMQNLFKMEKKIIKKYDPETPVTTNFHGLPNKMVDYQKWAKGQDIISYDSYPTYDAPAYKAAFLYDLMRSLKHQPFMLMESAPSQVNWQPYSPLKRPGQMEATEFQAVAHGADTVQFFQLKQAVGGSEKFHSAVIAHSQRTDTRVFKELADLGKKLKNAGPTILGSKTKAKVAIVFDWSNFWSYEYVDGITQDLNYVDSILDYYRQFYERNIPTDIIGVDDDFSNYDLVVAPVLYMVKHGLDKKINDYVENGGNFVTTYMSGMVNSSDNVYLGGYPGPLKEVTGIWVEESDAVVPGQKIKVLMNGKDYDTGLICNLIHPNDAKILATYASEFYAGTPAVTENQYGKGRAWYIGTRLEHQGLTQLFNHIIFETGVESLVCDSHKLEITKRVTEDGKELYFVLNMSNEERTLPSKFTGYEDILTGEKAHKDMKGWDVQVLRN

SEQ ID NO: 211 - DNA, 1884 bp, Lactobacillus acidophilus
  CDS (1)...(1884)
  misc_feature (0)...(0): ORF 1467; beta-galactosidase
atgcaagcaaacataaaatggcttgatgaccctgaaatttttagagtcaatcaattgccagctcatagcgatcatcctttttttaagaattatcgtgaatggcaaaataatcacagtagttttaagcaaagtttaaatggaatgtggcaattcaaattttctaaagatccccaaagccgtcccgttgacttctacaaaaaggactttaacacttcatctttcaccacaatcccagttcctagtgaaattgaattaaacaattttgcacaaaatcaatacattaatactctttatccctgggaagggaaaattttccgtcgtcctgcttacgcattaaataaatctgatgctgaagaaggttctttcagtgaaggtaaagataacaccgtcggttcatacataaaacattttgacctaaatccagaattaagggatcatgatattcatatcgtattcgaaggtgccgaacgagccatgtatgtttggttaaacggccatttcattggatatgccgaagatagctttactccttcggaatttgatttaaccaagtatattaaagaaaaagacaatatcttagctgttgaagtttttaaacacagtacggcttcttggcttgaagatcaagacatgttcagattttctggtctatttagatccgttgaattactagcatttcctgaaacacatttagttgatttggatcttaaacctactgtttgtgacaactatcaagatggtattttcaatgctgaattaaaatttactggttcactcaatggtcatgttcacttatccgtagaagacgtcaacggctcagctattttagaacaagatgtcccacttgactccgaagttgaatttactagctcaactttggaaaatattcatttatgggacaatcatcatccttacttgtatcagttattgattgaagtccatgatgaaaatggtcacctagttgaattaattccttaccaatttggctttagacgaattgaaattaatcaagacaaggtaattttactcaacggcaaatgcctaattattaacggagttaatcgccatgaatggaatgccaaaactggccgtagcattaccctgaacgatatggaaaaagatatcgatactttcaaagaaaacaatatcaacgctgttagaacttgccattatcccaaccaaatcccatggtattatctttgcgatcaaaacggcatttatatgatggcagaaaacaacctggaatctcatggtacctggcaaaagatggggcaagttgaaccatctgataatgtacctggttctgttcctgaatggcgtgaagcagtaatcgatcgcgcccgcaataattatgagactttcaaaaatcatacatccatcctattctggtcattaggaaacgaatcttatgccggtagtaatatcgttgcaatgaacgaattttacaaagaacatgattcttctcgtctagttcactacgaaggtgtcgttcatagaccagaattaaaagatcaaatttctgatattgaaagccatatgtatctaccacctaaagaggtcgcagaatacttaagaaataacccacaaaaaccatttatggagtgtgaatacatgcatgacatgggtaattctgatggtggtatgggcagctatattaaattaattgatgaatacccacaatatgtaggaggatttatttgggactttattgatcaagcgctcttagtctacgatcctatcagtaaacaaaacgttctccgttatggtggcgattttgatgatcgtcactcagactatgaattttctggtgatgggttaatgtttgcagatagaacaccaaagccagcaatgcaggaggttagatattactatggcttacacaaa

SEQ ID NO: 212 - protein, 628 aa, Lactobacillus acidophilus
MQANIKWLDDPEIFRVNQLPAHSDHPFFKNYREWQNNHSSFKQSLNGMWQFKFSKDPQSRPVDFYKKDFNTSSFTTIPVPSEIELNNFAQNQYINTLYPWEGKIFRRPAYALNKSDAEEGSFSEGKDNTVGSYIKHFDLNPELRDHDIHIVFEGAERAMYVWLNGHFIGYAEDSFTPSEFDLTKYIKEKDNILAVEVFKHSTASWLEDQDMFRFSGLFRSVELLAFPETHLVDLDLKPTVCDNYQDGIFNAELKFTGSLNGHVHLSVEDVNGSAILEQDVPLDSEVEFTSSTLENIHLWDNHHPYLYQLLIEVHDENGHLVELIPYQFGFRRIEINQDKVILLNGKCLIINGVNRHEWNAKTGRSITLNDMEKDIDTFKENNINAVRTCHYPNQIPWYYLCDQNGIYMMAENNLESHGTWQKMGQVEPSDNVPGSVPEWREAVIDRARNNYETFKNHTSILFWSLGNESYAGSNIVAMNEFYKEHDSSRLVHYEGVVHRPELKDQISDIESHMYLPPKEVAEYLRNNPQKPFMECEYMHDMGNSDGGMGSYIKLIDEYPQYVGGFIWDFIDQALLVYDPISKQNVLRYGGDFDDRHSDYEFSGDGLMFADRTPKPAMQEVRYYYGLHK

SEQ ID NO: 213 - DNA, 948 bp, Lactobacillus acidophilus
  CDS (1)...(948)
  misc_feature (0)...(0): ORF 1468; beta-galactosidase
atggcttacacaaataatttacaaatcatctatggtgatgccactttaggaatcactggtaaaaacttccattatcttttcagctacgaacgaggtgggttagaatcactcaacatcaataacaaagaatggttatatcgtgtgccgacccctactttctggcgagctactaccgataatgatcgaggtaatggctttaatttaaaggcatctcaatggctcggtgctgatatgtttactaaatgcactaaaatcgaattaaaggtagatgaccgacaattcgacgaacttccaattgctccaattaataatcaattcagtaatcatgaatatgctgaccatgttcaaattgcgttttggtatcaaactctaactaatccagcaactgacgttaaaatcatttataatattgataatactggttgtattaatatagtcatgcattattttggtaaaaaaggattgccaccattaccagtgattggaatgcgtttcatcatgccaactgctgcaactggctttgactacgaaggactttcgggggaaacttatcctgaccgaatggctggtgcaaaagaaggaaaattccatgttgatggcttaccagtaactaaatatttagtaccacaagaaaacgggatgcatatgcaaactaaggcactcaaaatcactcgttcttctactttaaataatgctgatcaagaaagtgaatttagtctaaagcttaagcaagataaacaaccgtttaattttagttgtttaccctacactgctgaagaattagaaaatgctactcatctcgaggaattaccacttgctcgcagaactgtgttagttattgctggagctgtgcgcggcgttggtggtatcgacagctggggtgctgatgttgaaaagcaatatcacattaatcctgaaaaagactacgaattttctttcaatcttaat

SEQ ID NO: 214 - protein, 316 aa, Lactobacillus acidophilus
MAYTNNLQIIYGDATLGITGKNFHYLFSYERGGLESLNINNKEWLYRVPTPTFWRATTDNDRGNGFNLKASQWLGADMFTKCTKIELKVDDRQFDELPIAPINNQFSNHEYADHVQIAFWYQTLTNPATDVKIIYNIDNTGCINIVMHYFGKKGLPPLPVIGMRFIMPTAATGFDYEGLSGETYPDRMAGAKEGKFHVDGLPVTKYLVPQENGMHMQTKALKITRSSTLNNADQESEFSLKLKQDKQPFNFSCLPYTAEELENATHLEELPLARRTVLVIAGAVRGVGGIDSWGADVEKQYHINPEKDYEFSFNLN

SEQ ID NO: 215 - DNA, 990 bp, Lactobacillus acidophilus
  CDS (1)...(990)
  misc_feature (0)...(0): ORF 1469; GalE
atgaaagttttagttgtaggtggtgcgggctacattggctcacatgccgttcgtgaattagtcaaagaaggtaatgatgtcgttgtactcgactctttatacaccggtcacagaaaggctgtcgatcctaaagcaaagttttatcaaggcgacatcgaggatactttcttagtatcaaagattttacgtgatgaaaaaattgacgctgtaatgcattttgcagcttattcattagtacccgaatcagttaaaaaaccacttaaatactacgataacaatgtttctggtatgatttcattattaaaagcaatgaatgatgcagatgtgaaatatttagtattctcaagttctgcagctacttacggtattcctaagaagttgccaattactgaagatactccacttgatccaattaacccatatggtgaaactaagatgatgatggaaaagatcatggcttgggctgacaaagctgacggtattaaatatactgctcttcgttacttcaatgtagctggtgcttcaagcgatggtactattggtgaagatcacggtcccgaaactcaccttattccaaatattttgaagagtgccatttcaggtgatggtaagtttactatcttcggcgatgattacaataccaaggatggtactaacgtccgtgattatgttcaagttgaagacttaattgatgctcacattttagcattgaagcatatgatgaagactaataaatctgacgtattcaatttaggtaccgcacaaggttactctaacttagaaatcttagaaagtgctaaaaaagttactggtattgatattccgtatacaatggggcctcgccgtggcggtgatcctgattcactagttgccgactcaactaaggcaagaactattttaggctggaagccaaaacatgaaaatgttgatgaagtaatcgaaaccgcttggaagtggcacaagagtcacccaaagggctacgaagacaag

SEQ ID NO: 216 - protein, 330 aa, Lactobacillus acidophilus
MKVLVVGGAGYIGSHAVRELVKEGNDVVVLDSLYTGHRKAVDPKAKFYQGDIEDTFLVSKILRDEKIDAVMHFAAYSLVPESVKKPLKYYDNNVSGMISLLKAMNDADVKYLVFSSSAATYGIPKKLPITEDTPLDPINPYGETKMMMEKIMAWADKADGIKYTALRYFNVAGASSDGTIGEDHGPETHLIPNILKSAISGDGKFTIFGDDYNTKDGTNVRDYVQVEDLIDAHILALKHMMKTNKSDVFNLGTAQGYSNLEILESAKKVTGIDIPYTMGPRRGGDPDSLVADSTKARTILGWKPKHENVDEVIETAWKWHKSHPKGYEDK

SEQ ID NO: 217 - DNA, 882 bp, Lactobacillus acidophilus
  CDS (1)...(882)
  misc_feature (0)...(0): ORF 1719; UDP-glucose phosphorylase
atgaaagtaagaaaagccatcattccagctgcaggtttggggacccgttttctaccagctactaaagctatgcctaaggaaatgttaccaattgtcgataagccaacaattcaatttattgttgaagaagctaaagctgcaggaattgaagatattttaattgttactggtaagaataagcgagcaattgaaaatcactttgattctaacccagaacttgaacaagacttggaagccactggtaaggttaagttattgaaattaactcaagatattactaacttgggaattaatttatactacactcgacaaccacatccagctggcttaggtgatgcaatttatcgtgcacgtagctttgtgggagaagaaccattcgttgttatgcttggtgatgacttaatgaaggacaaaattacattaactaagcaattgatgaatgattacgataagattcatgcatcaacaattgctgttatgcaggttccgcataaggaagtttccaagtacggtgtgattgatcctgaaggcaaggtggataaagatctttacaatgtaaagaaatttgttgaaaagcctgccgttgacaaggcaccaagtgattttgcaattattggacgttacttactcacaccggaaatttttgaaattcttgagaatcaaaagccaggtcgcggtggtgaaattcaattaactgatgccatcgatactttgaaccagactcaacgagtatttgcacatgtctttagaggtcaacgttttgatgtaggtaacaaggaaggctaccttgaaacctcaattcaatatggtttaagacaccctgaaactcgcgatgctttgaagaaatatattatcgacttaggcaagaagcttgaaaaggaa

SEQ ID NO: 218 - protein, 294 aa, Lactobacillus acidophilus
MKVRKAIIPAAGLGTRFLPATKAMPKEMLPIVDKPTIQFIVEEAKAAGIEDILIVTGKNKRAIENHFDSNPELEQDLEATGKVKLLKLTQDITNLGINLYYTRQPHPAGLGDAIYRARSFVGEEPFVVMLGDDLMKDKITLTKQLMNDYDKIHASTIAVMQVPHKEVSKYGVIDPEGKVDKDLYNVKKFVEKPAVDKAPSDFAIIGRYLLTPEIFEILENQKPGRGGEIQLTDAIDTLNQTQRVFAHVFRGQRFDVGNKEGYLETSIQYGLRHPETRDALKKYIIDLGKKLEKE

SEQ ID NO: 219 - DNA, 1446 bp, Lactobacillus acidophilus
  CDS (1)...(1446)
  misc_feature (0)...(0): ORF 874; beta-galactosidase
atgtattcagcaaaaatgccaaataattttttatggggcggtgctgttgctgctcaccaacttgaaggtgcttggaaagaaggcggaaaaggtacttccgttgccgatgttatgacagtaggatctgctactaagccacgtgaaatcaccgacggtgtgttacctggtaaaaactatcctaatcattcagctattgacttttatcatcattataaagaagacattaaattaatggctgaaatgggctttaaagcatttagaacttctattgcatggactagaatcttccctaacggtgatgaaactgaaccaaatgaagaaggcttaaaattttacgatgacttatttgatacttgtcatgaatacggtattgaaccagtcattaccctttcccactttgaaataccatttaatttagctaaaaattatagtggttttaccaatcgtaaagtaattgatttctttgttcgttttgcagaagtttgcttcaagcgttataagaacaaggttaaatattggatgacctttaacgaaatagataatcaatctgcatttaacgatgatttcttaatggctactaattcaggcattttatttaaagatggtatgactgataaagataaagaagctgcaatgtaccaagctggccactatgaattagttgcttctgctttagcagttaagattggtcataaaattaatcctgattttcaaattggttgtatgattaactactcacctgttcgcccacttactccatctagtgatgatgtactcttagcagataagtgggaacaacgccgtgattggttctcagatgttcatgtctttggtgaatatccaaatgctgtagaagcttacattgaaagaaatggctaccgtccagacatcaccgacgaagatagaatcgtattaaaggaaggcactgttgattacgtaggcttttcatattatcaatctactactgtatcaagcaaaaaagttatgccggatgatttaactgatttagctaaggcaattgctaaaaatcctactttaaagcgcagtgattggggttgggaaattgaccctgaaggtctcagaattgctttaaaccaattacaagatcgttaccacaagccattattcatcgtagaaaatggtcttggagcttatgacaaggttgaagcagatggttcaattcacgatgattatagaattgattatttgagaagtcatatttcagaaatggaaaaagctgttgaacttgatggtgttgacttgatgggttatcttccatggggatgcattgatctagtctctgctggtactggtcaaatggataagcgttacggctttatctacgttgacaaaaacgatgccggcgaaggtacactcgatcgttcacgaaaagattcattcttctggtataagaatgttatcgaatcaaatggtaaaaatctaggt

SEQ ID NO: 220 - protein, 482 aa, Lactobacillus acidophilus
MYSAKMPNNFLWGGAVAAHQLEGAWKEGGKGTSVADVMTVGSATKPREITDGVLPGKNYPNHSAIDFYHHYKEDIKLMAEMGFKAFRTSIAWTRIFPNGDETEPNEEGLKFYDDLFDTCHEYGIEPVITLSHFEIPFNLAKNYSGFTNRKVIDFFVRFAEVCFKRYKNKVKYWMTFNEIDNQSAFNDDFLMATNSGILFKDGMTDKDKEAAMYQAGHYELVASALAVKIGHKINPDFQIGCMINYSPVRPLTPSSDDVLLADKWEQRRDWFSDVHVFGEYPNAVEAYIERNGYRPDITDEDRIVLKEGTVDYVGFSYYQSTTVSSKKVMPDDLTDLAKAIAKNPTLKRSDWGWEIDPEGLRIALNQLQDRYHKPLFIVENGLGAYDKVEADGSIHDDYRIDYLRSHISEMEKAVELDGVDLMGYLPWGCIDLVSAGTGQMDKRYGFIYVDKNDAGEGTLDRSRKDSFFWYKNVIESNGKNLG

SEQ ID NO: 221 - DNA, 924 bp, Lactobacillus acidophilus
  CDS (1)...(924)
  misc_feature (0)...(0): ORF 910; L-LDH
atgagtagaaaagtgtttcttgtaggtgatggtgctgttggttcaacttttgcaaatgacttattgcaaaatacaactgttgatgaattagcgatttttgatgttgctaaagatcgtccagttggtgattcaatggatttggaagatattactccatttacaggtcaaactaatattcatccagcagaatatagtgatgctaaagatgcagatgtgtgtgtaattactgctggtgttcctcgtaaacctggtgaaactagacttgacttagttaataagaatgtaaagattttaaagactattgttgatccggttgttgaatccggttttaagggtgtatttgttgtttcagctaacccggttgatattttaaccacattgactcaaaaaatatccggttttccaaaagatcgtgtaattggtactggtacttcacttgattcaatgcgtcttcgcgttgaattggcaaagaaacttaatgttccagtagctaaggttaactcaatggttcttggtgaacacggtgatactagttttgaaaactttgacgaatcaactgttgacaataagccacttcgcgattactcagaaatcaatgataatgttttaagtgaaattgagtcagacgtccgtaaaaagggtggaaagatcatcactaacaaaggagctacattctatggtgttgctatgatgcttactcaaattgttagtgctattttagataatcgttcaatttgtttgccattatcagccccaattaatggtgaatatggcattaagcatgatctttacttaggtactccaactataattaacggtaatggtattgaaaaagttattgaaactaaactttcagatgtagaaaaagctaagatgatcaattctgcagataagatgcaagaagttttatcaggtgttgaaatg

SEQ ID NO: 222 - protein, 308 aa, Lactobacillus acidophilus
MSRKVFLVGDGAVGSTFANDLLQNTTVDELAIFDVAKDRPVGDSMDLEDITPFTGQTNIHPAEYSDAKDADVCVITAGVPRKPGETRLDLVNKNVKILKTIVDPVVESGFKGVFVVSANPVDILTTLTQKISGFPKDRVIGTGTSLDSMRLRVELAKKLNVPVAKVNSMVLGEHGDTSFENFDESTVDNKPLRDYSEINDNVLSEIESDVRKKGGKIITNKGATFYGVAMMLTQIVSAILDNRSICLPLSAPINGEYGIKHDLYLGTPTIINGNGIEKVIETKLSDVEKAKMINSADKMQEVLSGVEM

SEQ ID NO: 223 - DNA, 846 bp, Lactobacillus acidophilus
  CDS (1)...(846)
  misc_feature (0)...(0): ORF 1007; pyridoxal kinase
ttgattggggtgaaagttaaagtgataaatggaggagtgttaattagtcaagatttatcttgtgcaggtcaagtgtcaacatcagtagctttacctattcttggtgcatgtggtgccagaccgacagttttaccgacagcaattttatcaacacatactggctttaaagataatacttatcttgacttaagtaatgaaatgtctaggattatgtcccattggcaaaagattgatttggaatttaaagctatatatttgggctatttaggtaaagaagcattagatttttggattaaaaatattgaacaaataatacgtacaaatcaagttgttttaattgacccagcaatggcggatcatggaaagatgtatcgaggcttagatactgattacataaaaaagatgcgtcaattgatttttaaagcgacaattttaacacctaatataactgaagctgcgtttctattaaatgaagatataccagaaaattcattggagaaagcgcaagtattagctgaaaaattagtgcaaagatttgcaattcctaatgtaattatcacaggaattacattgtctaaagataaaataggcgaagtgggaataaccaaagaaggaaaatggtctattattcaagaaaaaatgccaggtgatttttttggaacaggtgatatgtttgcgagtgcatttttagcagcagtgttatatgggaaaaatttagaaaaaagttgtgcaattgcagcagaatttgttaaattagccattattgatatggatcaaaaattagaatccttatttggacctaattatgctgctggtttaccatggttattaagtgagttagaaaag

SEQ ID NO: 224 - protein, 282 aa, Lactobacillus acidophilus
MIGVKVKVINGGVLISQDLSCAGQVSTSVALPILGACGARPTVLPTAILSTHTGFKDNTYLDLSNEMSRIMSHWQKIDLEFKAIYLGYLGKEALDFWIKNIEQIIRTNQVVLIDPAMADHGKMYRGLDTDYIKKMRQLIFKATILTPNITEAAFLLNEDIPENSLEKAQVLAEKLVQRFAIPNVIITGITLSKDKIGEVGITKEGKWSIIQEKMPGDFFGTGDMFASAFLAAVLYGKNLEKSCAIAAEFVKLAIIDMDQKLESLFGPNYAAGLPWLLSELEK

SEQ ID NO: 225 - DNA, 2301 bp, Lactobacillus acidophilus
  CDS (1)...(2301)
  misc_feature (0)...(0): ORF 1812; alpha-glucosidase
atggctaacaaacttaaaaatttcatccaagatgggcaaaaagttaccttaaattatgaagatggggaacttgaattaagggttctaacgcctgaaattgtgcgtgtatttgaaaatcgtggcaatgctagcaattcatatgctatcgctggtgataaggaaataaaaactaattttcgtattgaagaaaaagatgatcatgcagagttatcaacagaaaagttgttcgtaaaaatttacgatgacaaaaagattgatgtttatgatgaaaaggatcatccattgatcattgattatcgcggtgagcgtacgccgattgatcgtcaaatggacgaggaacataaaaaatcggcagaatcagaaggtcatgaggttgctggtagtaaaaaagaagataaaaactattatgaaatcgttaaaaaactagctagtgatgaacaattttacggcttaggtgataagactggctttttaaataagcgtcattatgcctataataactggaatactgacgatccagcacctcaagttgaaagcttcccaagtctttataagtcggttccgatcttgctcggcttaaaagatggtcatccctatgggattttctttgacaatacttatcgtaaccacattgacttaggtaaagaaagtaacgattattactactactccgcagttgatggcaacattgattactacatcattggtggtgattcacttaaagaaattatcaccaactacacttacttgactggtcgtgtaccaatgccgcagaaatggaccttgggctatcaacagtctcgctggggctacagtgtcagccaaaagcaagttgagaaaattgcggaaaacttgcgcaagtatgatttgccgtgtgacgttttgcatcttgatatcgattatatgcgtgggtatcgtgtatttacctggagaaaagatacttatgaatcaccagataaattcatcaagaagatgcgtaaattgggctttagaatcatcacgattattgacccaggcgtaaagaaagatgatgactataagatttacaaggaaggtcttgaaaaaggctacttcgttaaggctccagatggtacggtttatgtaaatgaagtttggccaggcgatgctgtcttcccagactttggtcgcaaagaagtacgtaaatggtgggctagaaattgtaagtacttagttgatcttggcgtttcaggtatctgggacgatatgaatgaacctgcatcatttagaggtgaaattccacaagatattgtctttcataacgaagagcaagcttcaactcataagaagatgcacaatgtctatggtcataatatggctaaagcaacttatgaaggtttgaagaaatattcaggcaagcgtccctttgtcattacgcgtgcggcatatgcaggaacgcaaaagttttccacagtttggactggtgataaccaaagtttatggacgcatgtccaaatgatgattccgcaattatgtaacttgggaatgagtggatttagttttgccggtactgatattggtggtttcggtgctgatacgacgccagaattattgactcgttggatcgaaggtgcattatttagtccgttgtacagaaaccatgcggctctaggtactcgctcacaagagccatgggtatttggtgaaccaactttgtcaatttaccgtaaatacttgaaacttcgctaccgctttattccatatctttacgatgaattttatcgtgaaactaggacaggtttgccaattatgcggccacttgtcttgaattatgaaaatgatccacaggtgtataacttgaatgatgagtatatggttggcgaggatattttggcagccccagttgttcaagagggtcaaactaagcgtgccgtatatttgccaaaaggaaaatggattgatttttggaatggtgttgaatattctggaaagaccacgattttggttgatgcaccaattggtaaattgccattgttcattaagaagaatactatcctgccatggggcaaggaagtaagtcacatttccgatgagccagacgagagtatgacctttagagtatttggtaaaaagggtaagtacattcactatcaagataacggaactgacttcaagtaccaaaagggcgaatacaacttgtacaaggttaaggtaagtaaggatggtagcgtaaaggttaagcttgaaaagcatggcttcggtcctgtatatcgtagaattacggttcaattgcctaataagaaggttgaatttaagtacaagaatggtgaatacgttagaaaa

SEQ ID NO: 226 - protein, 767 aa, Lactobacillus acidophilus
MANKLKNFIQDGQKVTLNYEDGELELRVLTPEIVRVFENRGNASNSYAIAGDKEIKTNFRIEEKDDHAELSTEKLFVKIYDDKKIDVYDEKDHPLIIDYRGERTPIDRQMDEEHKKSAESEGHEVAGSKKEDKNYYEIVKKLASDEQFYGLGDKTGFLNKRHYAYNNWNTDDPAPQVESFPSLYKSVPILLGLKDGHPYGIFFDNTYRNHIDLGKESNDYYYYSAVDGNIDYYIIGGDSLKEIITNYTYLTGRVPMPQKWTLGYQQSRWGYSVSQKQVEKIAENLRKYDLPCDVLHLDIDYMRGYRVFTWRKDTYESPDKFIKKMRKLGFRIITIIDPGVKKDDDYKIYKEGLEKGYFVKAPDGTVYVNEVWPGDAVFPDFGRKEVRKWWARNCKYLVDLGVSGIWDDMNEPASFRGEIPQDIVFHNEEQASTHKKMHNVYGHNMAKATYEGLKKYSGKRPFVITRAAYAGTQKFSTVWTGDNQSLWTHVQMMIPQLCNLGMSGFSFAGTDIGGFGADTTPELLTRWIEGALFSPLYRNHAALGTRSQEPWVFGEPTLSIYRKYLKLRYRFIPYLYDEFYRETRTGLPIMRPLVLNYENDPQVYNLNDEYMVGEDILAAPVVQEGQTKRAVYLPKGKWIDFWNGVEYSGKTTILVDAPIGKLPLFIKKNTILPWGKEVSHISDEPDESMTFRVFGKKGKYIHYQDNGTDFKYQKGEYNLYKVKVSKDGSVKVKLEKHGFGPVYRRITVQLPNKKVEFKYKNGEYVRK

SEQ ID NO: 227 - DNA, 1380 bp, Lactobacillus acidophilus
  CDS (1)...(1380)
  misc_feature (0)...(0): ORF 1632; aldehyde dehydrogenase
atgtctaaatatcaatcagttaatccttatacaaatgaagcatttgccagttatgacaatcctacttctaagcaaattgatgaggcaattaacttagcacatgcactttataaaaagtggcgtcatgaagaaccagctagccgtgctgagattttacacgatattgctaatgcattaaaagaacacgaagatgaattggcaaaaatgatgacattagaaatggggaaacttttaagcgaatctaaagaagaagtagagttatgcgtttctatttgtaattattacgctgaccatggcccagaaatgcttaaacctactaaacttaattcagatttaggcaatgcatactacttaaaacaatcaaccggtgtaatcatggcctgtgaaccatggaacttcccactttatcaagtaattcgtgttttcgcacctaactttattgtgggtaatccaattttgctaaaacatgctcataacgttcctgggtctgctgcacttaccgctaaaattattaaacgtgctggtgctccagaaggcagtttaatcaacctatatccaagttatgatcaattagcagatattattgcagatcctagaattcaaggcgtagctttaaccggttctgaacgtggcggttctgctgtagctgaagctgctggcaagaatttaaagaaatcaacaatggaacttggtggtaatgatgcatttatcgttttagatgatgcagatccacaagttctgcgtaatgttcttaacgatgccagaacttataacgatggccaagtatgtacttcttctaagagaattattgtcgaaaaatcccgctatgatgaagtgctccatgaattaaagaacgtcttttcaaacttaaaagctggtgatccacttgaagctgacactactttaccaccgatgaattctgaaaaagctaaggaaaagctcgaagcccaagttaaggaggcaattgatgcaggtgctaaagtattttatcaatatcctgaaattgactctaaaggagcattctttagaccaactattttaactgatattgctaaagataatcccgtctttgacaaagaagtgtttggaccaattgctgaagtctttgttgtagaagacgataatgcagccattcaattagccaacgattcaagctatggcttgggctcatcagttattggtagcgatattgatcgtgcaaaaaaggtgtctgctcaaatcgaaactgggatgactgttattaacggtcgctggattacttctggtgaattaccatttggcggcataaagaaatccgggtatggtcgtgagttaagtggcctcggattaatggccttcgtcaatgaacatttagtcatcgatgttactaagaataatcaa

SEQ ID NO: 228 - protein, 460 aa, Lactobacillus acidophilus
MSKYQSVNPYTNEAFASYDNPTSKQIDEAINLAHALYKKWRHEEPASRAEILHDIANALKEHEDELAKMMTLEMGKLLSESKEEVELCVSICNYYADHGPEMLKPTKLNSDLGNAYYLKQSTGVIMACEPWNFPLYQVIRVFAPNFIVGNPILLKHAHNVPGSAALTAKIIKRAGAPEGSLINLYPSYDQLADIIADPRIQGVALTGSERGGSAVAEAAGKNLKKSTMELGGNDAFIVLDDADPQVLRNVLNDARTYNDGQVCTSSKRIIVEKSRYDEVLHELKNVFSNLKAGDPLEADTTLPPMNSEKAKEKLEAQVKEAIDAGAKVFYQYPEIDSKGAFFRPTILTDIAKDNPVFDKEVFGPIAEVFVVEDDNAAIQLANDSSYGLGSSVIGSDIDRAKKVSAQIETGMTVINGRWITSGELPFGGIKKSGYGRELSGLGLMAFVNEHLVIDVTKNNQ

SEQ ID NO: 229 - DNA, 1362 bp, Lactobacillus acidophilus
  CDS (1)...(1362)
  misc_feature (0)...(0): ORF 1401; NADH peroxidase
ttggataagagaaaagtaattattgttggtgcttcacatggtggtcatgaatcagcaattgagttattagacaagtacgatgacgttgacgtaactatttacgaagccggtgacttcatttcattcatgtcatgcgggatgcaattattccttgaaaataaagttactgcagaagatgatgtaagaaactttgcacctgaagatattgagaaaaaaggcggtcatgtttatgccaatcatgaagtgactgctgttcatcccgacaagaagacagttactgtaaaagacttaactaatgattctgaagaagaagttagttatgataaattaattttatcttctggtgtaacgccaaaagttttgcctgttccaggtagtgatttaaagaatatctacttaatgcgtggacgtgactgggcttctaagttaaaagcggcaaccactgatccagcaattaagaacgtagctatcattggtgcaggttacattggtactgaagctagcgaagtatttgccaaagcaggcaagcatgtaaccttgatggatatgattgatcgtcctttaggaacttaccttaatcctgaattattggatatcttagaaccaacatttaaggatcatatggatcttaaaatgggcgttaagattgagggatttaatggcactgataaagttgaaagtgtcgagacagacaacggtgatgtatctgctgacttagttgtggtttctgctggtgtaagtcctaacactgattggttaaagggcactgttgatcttgatcaaagaggctggattaagactgatccatacttgagaactaatgttaaagatgtttatgcaattggagatgctattttgccatattcaattcctgcaggtaaaccaatgccaattgcattagcaacaactgctcgtcgtgaagcacaatatttagtcgatcacttatttgaagctaaacctgatcaagtattcaaaggtgtaattggtgcttctgcattaagcgtatttgattatcattttgctacagcaggtttgaatcaattctcagctgaaaagaatgatattccatatggaactagtttttatgaagattcaatgcgtccagcttatattccagaaaaggataatcctaaggtttatgtaagtttaactttcaatccatataaccatcaaattttgggtggtgctgttctttctaaatatgacgttactgctcaaggcaatgttttggctttggcaatcagtcataaaatgactcttgaagatttggctgagcaagatttcttcttccaacccggatttgaccgccaatggagcttactcaacttagccgcacaacatgccttaggtttagctagattt

SEQ ID NO: 230 - protein, 454 aa, Lactobacillus acidophilus
MDKRKVIIVGASHGGHESAIELLDKYDDVDVTIYEAGDFISFMSCGMQLFLENKVTAEDDVRNFAPEDIEKKGGHVYANHEVTAVHPDKKTVTVKDLTNDSEEEVSYDKLILSSGVTPKVLPVPGSDLKNIYLMRGRDWASKLKAATTDPAIKNVAIIGAGYIGTEASEVFAKAGKHVTLMDMIDRPLGTYLNPELLDILEPTFKDHMDLKMGVKIEGFNGTDKVESVETDNGDVSADLVVVSAGVSPNTDWLKGTVDLDQRGWIKTDPYLRTNVKDVYAIGDAILPYSIPAGKPMPIALATTARREAQYLVDHLFEAKPDQVFKGVIGASALSVFDYHFATAGLNQFSAEKNDIPYGTSFYEDSMRPAYIPEKDNPKVYVSLTFNPYNHQILGGAVLSKYDVTAQGNVLALAISHKMTLEDLAEQDFFFQPGFDRQWSLLNLAAQHALGLARF

SEQ ID NO: 231 - DNA, 1803 bp, Lactobacillus acidophilus
  CDS (1)...(1803)
  misc_feature (0)...(0): ORF 1974; pyruvate oxidase
atgactaaaattaatggttctgacgcaatgcttaaagttatttacgactggggaatagatcatatttatggttttccaggtggatcttttgattcaagcatgaatgctatttatgactttagagataaaatgaaatttatcgaggtccgccacgaagaagcaggtgcacttgctgcttcttcggaatacaaagtaactggtaaactgggtgtatgtttcggctcagcaggtcctggtgctgctcacttatttaatggcttatatgatgcaaaatatgataaaacaccaatgcttgctatcgttgctaatgtacctactagcaaacaagatattgactttttccaagcatttgacgaagataaatggttcttggatgcaagtgtatggtgtgcttcagcaaagacaccagaacttattcctgtattgactgatgaagctattcgccaagcatatgcaagaaagggtccagcagttttgatcattcctaaggattacggatggcaaaagattgaagataacttccgtgtaagtaagaaggcacaaccaaagcctaactatccagctccaactgaaacttcagtcgaagaggctgtaaagcttttaaaggaagcaaagaatcctactatgtacatcggcgcaggtgctaaagatgctggtgaagaagttaaggaatttgcggaaaaattcaaaactcctattatgtcatcatacctaggtaaaggcgtggttgaagataagttcccagcttacattggtactattggtcgtattggccctaaggcagcacaagaagttcaaacagcaactgacctggttgtttgggtaggtaataactcaccattttcaggcttgtggttccctaaggatgctaaggttatccaaatcgatgttgacccaggtaaatttggtaagcgtcattcaactgatgtttcaatgcttgcggattctaagaaagctcttcgtgctcttattgaagaaggggaagaaagaagcgaatcaccactttataaagcagctattgcagaccgcgagaactgggatgcatgggaagatagctttaagaattctgatgaaatgccagttcgtccagaacctatatgggatgttatcaacaagaaagctgatgacaatgcgatttttgcaattgatgtaggtaatgtaaatgttgattcatgtcgtcttttgaatttacatgatgatcaaaagtggactacttctggtcttcacgcaactatgggttatggtgccccagctgctcttatggctgctacagtatatccagaccgtgaagtttggaacttagccggtgatggcggctttgccatgatgaatcaagagcttttgactatgtcacgttacaatatgcatgttttaaatgtggtatttactaacgaaactttaggttatatcgaggctgagcaagttgatgaatctcaccagcctttgtcaggcgttattattcctgataataattgggcaaaagtggcagaaggtatgaacgttaagggcgttgttgtacgtactaaagaagaatttgaaaaagcagtagatgaattcaagcaaatggatggtccaatgcttatcgatattaagtacactcacaagatgccatattcaactgaattgaattcacttgatgatccagcatttgttaagaaatatgaagctgaagatttgaagccgtttagttactttgcagaaaagtatggcttggaagctgatgccgcaacgggtgcatctcaacatgaaggagaaccagtagaagatacaactcctgatacagtttcaggtgcatctcaacac

SEQ ID NO: 232 - protein, 601 aa, Lactobacillus acidophilus
MTKINGSDAMLKVIYDWGIDHIYGFPGGSFDSSMNAIYDFRDKMKFIEVRHEEAGALAASSEYKVTGKLGVCFGSAGPGAAHLFNGLYDAKYDKTPMLAIVANVPTSKQDIDFFQAFDEDKWFLDASVWCASAKTPELIPVLTDEAIRQAYARKGPAVLIIPKDYGWQKIEDNFRVSKKAQPKPNYPAPTETSVEEAVKLLKEAKNPTMYIGAGAKDAGEEVKEFAEKFKTPIMSSYLGKGVVEDKFPAYIGTIGRIGPKAAQEVQTATDLVVWVGNNSPFSGLWFPKDAKVIQIDVDPGKFGKRHSTDVSMLADSKKALRALIEEGEERSESPLYKAAIADRENWDAWEDSFKNSDEMPVRPEPIWDVINKKADDNAIFAIDVGNVNVDSCRLLNLHDDQKWTTSGLHATMGYGAPAALMAATVYPDREVWNLAGDGGFAMMNQELLTMSRYNMHVLNVVFTNETLGYIEAEQVDESHQPLSGVIIPDNNWAKVAEGMNVKGVVVRTKEEFEKAVDEFKQMDGPMLIDIKYTHKMPYSTELNSLDDPAFVKKYEAEDLKPFSYFAEKYGLEADAATGASQHEGEPVEDTTPDTVSGASQH

SEQ ID NO: 233 - DNA, 840 bp, Lactobacillus acidophilus
  CDS (1)...(840)
  misc_feature (0)...(0): ORF 1102; amino acid permease
atgaatattattattgcattgcttccagcaattggttggggaattattccattgattgtaagtaaggttaaaaatagtcatccaactaatcaaattttaggagtaggtgtcggagcaactatctttggaatttttgttacagtgcttcaaagaccttcaatgaatttatcaatttttttactttcaatgatttctggagcattctgggccattggtcaaattggtcaatttgtttcatttactaaaatgggtgtaagtaagacaatgccaatttcaactggtttacaattgattggtaacacaattatcggtgcactcatttttggtgaatggagtactattaatcaatatgtattgggaacacttgcattgatcttgattataattggtgttgtattaactacagttactagaaaagcttcatcacaaaagactaatagtaaagatttattattcttacttttaactactattggttactgggtttattcagcatttccaaaagcagtttcagctagtgcccaatcaatgtttttaccacaaatgattggtatcttaattggagcaagcttatatgtaatctttactaagagagccgtagcttttaaacaaaaagcgacttggtttgatgtacttgcaggttttgcttttggtattggtgcatatacttatatcatttcagctcaaatgaatggtgtaactaatgcgtttatttatagtcaattgagtgtaattatttcgaccttaggcggtatgacaatcttgggtgaacacaaatatggtcgtgaacttgtttcaactttaattggtttagcattgatcgtcgttggcgcagtttta

SEQ ID NO: 234 - protein, 280 aa, Lactobacillus acidophilus
MNIIIALLPAIGWGIIPLIVSKVKNSHPTNQILGVGVGATIFGIFVTVLQRPSMNLSIFLLSMISGAFWAIGQIGQFVSFTKMGVSKTMPISTGLQLIGNTIIGALIFGEWSTINQYVLGTLALILIIIGVVLTTVTRKASSQKTNSKDLLFLLLTTIGYWVYSAFPKAVSASAQSMFLPQMIGILIGASLYVIFTKRAVAFKQKATWFDVLAGFAFGIGAYTYIISAQMNGVTNAFIYSQLSVIISTLGGMTILGEHKYGRELVSTLIGLALIVVGAVL

SEQ ID NO: 235 - DNA, 894 bp, Lactobacillus acidophilus
  CDS (1)...(894)
  misc_feature (0)...(0): ORF 1783; ABC transporter
atgttaaaaatagaacacctaaacaaaagcttcgggtcaacacaggttttgtttgatgttagcttcaatgtgtcagatggacgtattcttggactggttggtaaaaatgggtcgggtaagtcgacgatctttcatagtattttgaaattcgttgattatgacggtcagattagtattgatggacattctttcaacgctaaagattatgacaatattggctatctgcctgaagagcgaagtttgatgcctaaattaactatttcagatcaggtagtgtttttaactagccttaaagggatgccggctaaaaaggtaaaagaagaattgcctgattggttatcacgtttggctgttaaagggatcccaatggataagattaagtctttgtctaaaggtaaccaacaaaaagtacagatgattgcgactttaattcatcaacctaaattgattattttagatgaaccttttagtggattagatcccgttaacgttgatctaatgaagcagctgattttagaagaaaaaagaaaaggcgccacaatcatcttttctgatcatgatatgcgtaacgtggaagaattgtgcgatgacgtcgtgatgatcaatgatgggcatatcgtcttgaatggtccagtaaatgaaattaagaacagctttggcctaactcgagtttttgtcagaacagataaaagtgctgctgaattatcagccttgtcaggtgtaaaagatgtgattttgcaaaacaatggaatgaagttgcttattcttgaagacgaaaaatatggtaaggatatttttaaccaactttcggatggtcaatatattcaaacttttgaccaggaaccaccaactttagacgagattttcaaaatgaaagcaggtgcgcgtcatgaa

SEQ ID NO: 236 - protein, 298 aa, Lactobacillus acidophilus
MLKIEHLNKSFGSTQVLFDVSFNVSDGRILGLVGKNGSGKSTIFHSILKFVDYDGQISIDGHSFNAKDYDNIGYLPEERSLMPKLTISDQVVFLTSLKGMPAKKVKEELPDWLSRLAVKGIPMDKIKSLSKGNQQKVQMIATLIHQPKLIILDEPFSGLDPVNVDLMKQLILEEKRKGATIIFSDHDMRNVEELCDDVVMINDGHIVLNGPVNEIKNSFGLTRVFVRTDKSAAELSALSGVKDVILQNNGMKLLILEDEKYGKDIFNQLSDGQYIQTFDQEPPTLDEIFKMKAGARHE

SEQ ID NO: 237 - DNA, 816 bp, Lactobacillus acidophilus
  CDS (1)...(816)
  misc_feature (0)...(0): ORF 1879; pyrimidine kinase
atgacagatcaaaatcaaaaaattgcagtaactattgctggtaatgacagcgatggtagcgcggggatgcctgcagacttacattcattttttgcacgtggcgtttacggtatggggttattaaccgctgctgttgctggtaatacaactggaatttatgcagcagaagtaatgcccgttgactttattcaaaaacaattcgatgttttagctgatgactttacaattaatgctgctaaaaccggtatggttgccgattctaaggtaatgaacgttgttgccgataatcttgaaaaatatgacttcggtaaaattgttatcgatcccgtaatctctactaaacatggcaacactttaatggacgatgattcctataatacttttattaaacgtcttgtgccgcttgccgatataattacgcctaacttctatgaacaaaagaaattaactaaccttgaattaaacaatcttaatgaggttaaaaaaggcgctaaaatgttgcaagatatgggtgctaagaacgttttgatgaaaggacgccatgatggtgatcaaactgaagtaactgatcttttgcttaccgaagacggccaatttcatacctttaccaagtcatattttaagactgatcgtgtaaacggaactggcgatacgttatccgcagttattgcagcagaacttgctaaaggtaatgatttaattgatagtgtcaagattgctaaagactttacctatgaggcaatttcacacccaattaatgttggttcaaagtttggcccaattaatcatttggctgcgcagaaaaataataatgaa

SEQ ID NO: 238 - protein, 272 aa, Lactobacillus acidophilus
MTDQNQKIAVTIAGNDSDGSAGMPADLHSFFARGVYGMGLLTAAVAGNTTGIYAAEVMPVDFIQKQFDVLADDFTINAAKTGMVADSKVMNVVADNLEKYDFGKIVIDPVISTKHGNTLMDDDSYNTFIKRLVPLADIITPNFYEQKKLTNLELNNLNEVKKGAKMLQDMGAKNVLMKGRHDGDQTEVTDLLLTEDGQFHTFTKSYFKTDRVNGTGDTLSAVIAAELAKGNDLIDSVKIAKDFTYEAISHPINVGSKFGPINHLAAQKNNNE

SEQ ID NO: 239 - DNA, 1914 bp, Lactobacillus acidophilus
  CDS (1)...(1914)
  misc_feature (0)...(0): ORF 680; glgB
atggtaacgatagtggaggttaaacaacatattaaaaaatttgcagctggcaatgagctatatcttcaagaagtattagggtgtcattatgaaaatgatatctatacttttagagtatgggcaccaaatgcgcaaaaagtttggctagttggcgattttaatgattgggataaatcattagaaatgagtcagactttagatggagtttgggaaataaagaccagcttacccaaagaaggacagctatataagtttctagttaaacaagctgatggtcgtgaggtaatgaaaattgatcctatggcgttcgaattagagcctagaccaggcagtgcagctgtgattgttaagttacctaataaaaagtggcttgacggtgcatggatgggacgaaataaaagatcgaatcattttgctcgaccaattaatatttatgaagtacatgctagttcatggaaaagacatacagatgggtctctgtatactttgaaggatttacaaaaggaattaattccgtatgttaaagaacaaggatttaattatatcgaatttttgcctttaacagcacatcctttagatgcttcatggggatatcaaacaattggttattatgctttggagcgtacttatggtacaccacgagagctgcaagattttgttgaagcatgtcacaaagaaaacatcggtgttttggctgattgggtaccaggacacttttgtattaatgatgatgccttggcttattatgatggcacaccatgttatgaatttagcgaaaaatggagagccgaaaataaaggctggggagctctaaattttgatttaggcaaaccggaagtgcaatcatttttactttctagtgccctattttggctagaattttatcatttggatggcttgagagttgatgctgtttctaacatgatttatcgcgattatgaccgcagtgacggtgaatggaaaacagataaatttggtggaaatcgtaatttagaggggatagaattcctacaaaaactaaatcgaaccattaaaggcaaacatccagaatgtttaatgattgccgaggaaagttctgctcaagtaaagataactggtcgaatagaagatggtgggttaggttttgattttaaatggaatatgggttggatgaacgatattttacgtttttatgagatggacccattatttagaaaatttaattttaatctagctactttttcattcatgtatcgaatgagtgaaaactttattttacctttatcacatgacgaggttgttcatggtaagcgaagcctaatgaataaaatgtttggcgaccgtgataagcaatttgctcaattacgtaatttacttacattgcaaatgacctatcctggtaaaaagcttttatttatgggaagtgaatttggacaatatcttgaatggcgatataacgatggcttagattgggcagaattaaaggatgaactgaatgctaaaatgaagcattttgatcaagatttaaatagtttttatttaaatgagccggctttgtggcaattagaacaaagagaagattctgttcaaattattgacgcagataataaagatgagtcagtcttgtcatttattcgtcaaggtaaaactagacatgactttttaatagttattttgaattttacacctgttgatcgaaaaaaaattacaattggtgttccatatgctggtaaatattgtgaagtctttaatagtgccagaaaagaatatggtggcagttggaaccaagaaaagcagaatttgaaaactcaaaataattcatttaagaattttaattatcaagtgcaattggatataccgggttttagtgctgtgattttaaaacctgtagatgttcatataaaaagaagaattaatagaaaaacaaaaactaag

SEQ ID NO: 240 - protein, 638 aa, Lactobacillus acidophilus
MVTIVEVKQHIKKFAAGNELYLQEVLGCHYENDIYTFRVWAPNAQKVWLVGDFNDWDKSLEMSQTLDGVWEIKTSLPKEGQLYKFLVKQADGREVMKIDPMAFELEPRPGSAAVIVKLPNKKWLDGAWMGRNKRSNHFARPINIYEVHASSWKRHTDGSLYTLKDLQKELIPYVKEQGFNYIEFLPLTAHPLDASWGYQTIGYYALERTYGTPRELQDFVEACHKENIGVLADWVPGHFCINDDALAYYDGTPCYEFSEKWRAENKGWGALNFDLGKPEVQSFLLSSALFWLEFYHLDGLRVDAVSNMIYRDYDRSDGEWKTDKFGGNRNLEGIEFLQKLNRTIKGKHPECLMIAEESSAQVKITGRIEDGGLGFDFKWNMGWMNDILRFYEMDPLFRKFNFNLATFSFMYRMSENFILPLSHDEVVHGKRSLMNKMFGDRDKQFAQLRNLLTLQMTYPGKKLLFMGSEFGQYLEWRYNDGLDWAELKDELNAKMKHFDQDLNSFYLNEPALWQLEQREDSVQIIDADNKDESVLSFIRQGKTRHDFLIVILNFTPVDRKKITIGVPYAGKYCEVFNSARKEYGGSWNQEKQNLKTQNNSFKNFNYQVQLDIPGFSAVILKPVDVHIKRRINRKTKTK

SEQ ID NO: 241 - DNA, 1047 bp, Lactobacillus acidophilus
  CDS (1)...(1047)
  misc_feature (0)...(0): ORF 55; D-LDH
atggtcatactaataaattttacggaggttaaatttatgacaaagatttttgcttacgctattcgtaaagacgaagaaccattcttaaacgaatggaaggaagctcacaaagatatcgatgttgattacactgataaacttttgactcctgaaactgcaaagcttgctgaaggtgcagacggtgttgttgtttaccaacaattagactacactcctgaaacccttcaagcattggcagatgctggcgtaactaagatgtcattacgtaacgttggtgtcgataacatcgacatggacaaggccaaagaattaggctttgaaatcactaatgttcctgtttactcaccagacgctattgctgaacatgctgctattcaagctgcacgtgtattacgtcaagacaagcgcatggacgaaaagatggctaaacgtgatttacgttgggcaccaactatcggccgtgaagttcgtgaccaagttgtcggtgttgttggtactggtcacattggtcaagtatttatgaagattatggaaggctttggcgcaaaagttattgcttacgatatcttcaagaaccctgaacttgaaaagaagggttactacgttgattcacttgatgacttgtacaagcaagctgatgtaatttcacttcacgtaccagacgttccagctaacgtacacatgattaacgatgaatcaatcgccaaaatgaaggatggcgttgtaatcgtaaactgctcacgtggtccacttgttgacactgatgcagtaattcgtggtttagactcaggcaagatcttcggcttcgttatggatacttacgaaggcgaagttggtgtatttaacaaggactgggaaggtaaagaattcccagacgaacgcttggcagacttaattgatcgtccaaacgtattggtaaccccacacactgccttctacactactcacgctgtacgtaacatggttgttaaggcatttgacaacaacttggaattaatcaagggcgaaaaaccagattctccagttgctttggacaagaacaagttc

SEQ ID NO: 242 - protein, 349 aa, Lactobacillus acidophilus
MVILINFTEVKFMTKIFAYAIRKDEEPFLNEWKEAHKDIDVDYTDKLLTPETAKLAEGADGVVVYQQLDYTPETLQALADAGVTKMSLRNVGVDNIDMDKAKELGFEITNVPVYSPDAIAEHAAIQAARVLRQDKRMDEKMAKRDLRWAPTIGREVRDQVVGVVGTGHIGQVFMKIMEGFGAKVIAYDIFKNPELEKKGYYVDSLDDLYKQADVISLHVPDVPANVHMINDESIAKMKDGVVIVNCSRGPLVDTDAVIRGLDSGKIFGFVMDTYEGEVGVFNKDWEGKEFPDERLADLIDRPNVLVTPHTAFYTTHAVRNMVVKAFDNNLELIKGEKPDSPVALDKNKF

SEQ ID NO: 243 - DNA, 690 bp, Lactobacillus acidophilus
  CDS (1)...(690)
  misc_feature (0)...(0): ORF 185; phosphoglycerate mutase
atgtcaaaattagttttaatccgtcacggtcaaagtgaatggaacctttcaaaccaatttactggttgggttgacgttaacctttcagaaaaaggtgttgaagaagctaagaaggctggtcgtttaatcaaggaacacggtcttgaatttgatcaagcttacacttcattattaactcgtgctatcaagactttgcactacgcattggaagaaagtgaccaactttggattccagaaactaagacttggagacttaacgaacgtcactacggtgctcttcaaggcttgaacaagaaggctactgctgaaaagtacggtgatgaacaagttcacatttggcgtcgttcatacgatgttttgccaccagctattgacgatgacaacgaatttagtcaagcacatgaccgtcgttacgcaaacttggatccacacatcgttcctaaggcagaaaacttacacgtaactttggatcgtgtaatgccattctgggaagataacattgctccagacttacttgacggtaagaacgtaattattgctgcacacggtaactcacttcgtgctttgactaagtacattgaaaacatttctgacgatgacatcatggacctcgaaatgaagactggtgaaccagttgtttacactttcgacgaaaacttggatgttgttaacaaggaaaagttggacgac

SEQ ID NO: 244 - protein, 230 aa, Lactobacillus acidophilus
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKATAEKYGDEQVHIWRRSYDVLPPAIDDDNEFSQAHDRRYANLDPHIVPKAENLHVTLDRVMPFWEDNIAPDLLDGKNVIIAAHGNSLRALTKYIENISDDDIMDLEMKTGEPVVYTFDENLDVVNKEKLDD

SEQ ID NO: 245 - DNA, 969 bp, Lactobacillus acidophilus
  CDS (1)...(969)
  misc_feature (0)...(0): ORF 271; L-LDH
atggcaagagttgaaaaacctcgtaaagttattttagttggtgacggtgctgtaggttctacctttgcattttcaatggtgcaacaaggtattgctgaagaattaggtatcattgatattgctaaggaacacgttgaaggtgacgcaatcgacttagcagatgctactccatggactttcccaaagaacatttacgcagctgactacgctgactgcaaggacgcagacttagtagttattactgctggtgctccacaaaagccaggtgaaactcgtcttgaccttgttaacaagaacttgaagattttatcatcaatcgttgaaccagttgttgaatcaggctttgaaggtatcttcttagtagttgctaacccagttgacatcttgactcacgcaacttggaagatttcaggcttccctaaggatcgcgttattggttcaggtacttcacttgatactggtcgtcttcaaaaggttatcggtaagatggaacacgttgacccacgttcagttaatgcatacatgcttggtgaacacggtgatactgaattcccagtatggagctacaacaatgttggtggcgtaaaggttagcgactgggttaaggctcacggtatggatgaatctaagcttgaagaaatccacaaggaagttgctgacatggcttacgacattatcaacaagaagggtgctactttctacggtatcggtacagcttcagcaatgatcgctaaggctatcttgaacgatgaacaccgtgtacttccactctcagttgcaatggatggtcaatacggtttacacgaccttcacattggtactcctgcagttgttggccgtaacggtcttgaacaaattattgaaatgcctttaaccgctgatgaacaagctaagatggaagcttctgctaagcaattaaaggaagttatggacaaagcctttgaagaaactggcgttaaggttcgtcaa

SEQ ID NO: 246 - protein, 323 aa, Lactobacillus acidophilus
MARVEKPRKVILVGDGAVGSTFAFSMVQQGIAEELGIIDIAKEHVEGDAIDLADATPWTFPKNIYAADYADCKDADLVVITAGAPQKPGETRLDLVNKNLKILSSIVEPVVESGFEGIFLVVANPVDILTHATWKISGFPKDRVIGSGTSLDTGRLQKVIGKMEHVDPRSVNAYMLGEHGDTEFPVWSYNNVGGVKVSDWVKAHGMDESKLEEIHKEVADMAYDIINKKGATFYGIGTASAMIAKAILNDEHRVLPLSVAMDGQYGLHDLHIGTPAVVGRNGLEQIIEMPLTADEQAKMEASAKQLKEVMDKAFEETGVKVRQ

SEQ ID NO: 247 - DNA, 1014 bp, Lactobacillus acidophilus
  CDS (1)...(1014)
  misc_feature (0)...(0): ORF 698; GPDH
atgacagttaaaattggtattaacggtttcggccgtattggtcgtttagcattccgtcgtattatggacttgggcgaaaagtcaaaggatatcgaagttgttgcaattaacgacttgactactccagcacttttggcacacttacttaagtatgactcaactcatggtactttcgaccacgaagtttcttcaactgaagattcaatcgtagttgacggtaagaagtaccgtgtttacgctgaaccacaagcacaaaacattccatgggttaaaaacgacggtgttgacttcgttcttgaatgtactggtttctacactagcaaggctaagtcacaagctcaccttgacgcaggtgttaagcgtgtattgatctcagcaccagcaggtaacgacttgaagactatcgtttactcagtaaaccaagatactttgactgctgacgacaagatcgtttcagctggttcatgtactactaactcattggcaccaatggttaacgctttacaaaaggaattcggtattgaagttggtactatgactactatccacgcatacacttcaactcaaatgatcttggatggtcctgtacgtggtggtaacttacgtgctgctcgtgctgctgctatcaacattattcctcactcaactggtgctgctaaggctatcggccttgttattccagaattgaacggtaagttgaacggtcacgcacaacgtgttccagttccagatggttcagtaactgaattagtatcaatcttgggcaagaacgttactgctgatgaagttaacgaagctatgaagaagtacgaaagtccttcatttgaatatgaaccaaacaatgttgtttcaagcgacattttaggcagaactgctggttcaatctttgacccaactcaaactatggtaactactgcaggtgacaagcaattagttaagactgttgcttggtacgacaatgaatactcattcacttgccaaatggttcgtactttgttacactttgctactctt

SEQ ID NO: 248 - protein, 338 aa, Lactobacillus acidophilus
MTVKIGINGFGRIGRLAFRRIMDLGEKSKDIEVVAINDLTTPALLAHLLKYDSTHGTFDHEVSSTEDSIVVDGKKYRVYAEPQAQNIPWVKNDGVDFVLECTGFYTSKAKSQAHLDAGVKRVLISAPAGNDLKTIVYSVNQDTLTADDKIVSAGSCTTNSLAPMVNALQKEFGIEVGTMTTIHAYTSTQMILDGPVRGGNLRAARAAAINIIPHSTGAAKAIGLVIPELNGKLNGHAQRVPVPDGSVTELVSILGKNVTADEVNEAMKKYESPSFEYEPNNVVSSDILGRTAGSIFDPTQTMVTTAGDKQLVKTVAWYDNEYSFTCQMVRTLLHFATL

SEQ ID NO: 249 - DNA, 1209 bp, Lactobacillus acidophilus
  CDS (1)...(1209)
  misc_feature (0)...(0): ORF 699; phosphoglycerate kinase
atggctaaattaatcatttcagacctcgacgttaaaggtaaaaaagttttagtacgtgtagactttaatgttcctattaaagatggcgttattggtgatgataaccgtatcgttgctgcacttcctactattaagtacattattgaacatggtggtaaggcaattttgcttagccacttaggtcgtgtaaagtcagatgctgataagaaggaattgtcattgaagccagttgctgaacgtttaagcgaacttcttgacaagcctgtaacttttgtaccatcaaacgaaggtaaagaagttgaagaagcaatcgacaacatgaaagacggagatgttgttgttcttgaaaacactagattccaagatatcgacaacgatttcggtaagcgtgaatcaggtaacgatccaaaacttggcgaatactgggcaagtcttggcgatatctttgtaaacgatgctttcggtactgcacacagaagtcacgcttcaaacgttggtattgcaaccgctatgaaggaaaatggtaagcctgctgcagctggttacttacttgaaaaggaaattaagtacttaggtgacgccgttgataatcctgtacacccatttgttactattttgggtggtgctaaggtttcagacaagatcggtgttatcgaaaacttgattcctaagtcagatcacatcttaattggtggtggtatggcttacacattcttagctgctcaaggtcacaagattggtaaatcattatttgaagctgataaggttgatcttgctaaggaattgcttgaaaaggctggcgacaagatcgttcttccagttgacaacgtagctgcaactgaattctcaaacgatgcttcacgtgaagttgttggtgacgacattcctgataatatgatgggtcttgacattggtcctaagactattgctaagtttaaggacatcttaaaggatgctaagactgttgtttggaatggaccaatgggtgctttcgaaatgcctaactttgctgaaggtactttagaagtaggtcgtgctttggcaaaccttactgacgcaactactattatcggtggtggtgactcaactgctgctgctaagcaattgggtatcgcacctaagattagccacatttcaactggtggtggtgcttcacttaactaccttgaaggtaaagtattgccaggtatcgcttgcgtttcagacaag

SEQ ID NO: 250 - protein, 403 aa, Lactobacillus acidophilus
MAKLIISDLDVKGKKVLVRVDFNVPIKDGVIGDDNRIVAALPTIKYIIEHGGKAILLSHLGRVKSDADKKELSLKPVAERLSELLDKPVTFVPSNEGKEVEEAIDNMKDGDVVVLENTRFQDIDNDFGKRESGNDPKLGEYWASLGDIFVNDAFGTAHRSHASNVGIATAMKENGKPAAAGYLLEKEIKYLGDAVDNPVHPFVTILGGAKVSDKIGVIENLIPKSDHILIGGGMAYTFLAAQGHKIGKSLFEADKVDLAKELLEKAGDKIVLPVDNVAATEFSNDASREVVGDDIPDNMMGLDIGPKTIAKFKDILKDAKTVVWNGPMGAFEMPNFAEGTLEVGRALANLTDATTIIGGGDSTAAAKQLGIAPKISHISTGGGASLNYLEGKVLPGIACVSDK

SEQ ID NO: 251 - DNA, 1335 bp, Lactobacillus acidophilus
  CDS (1)...(1335)
  misc_feature (0)...(0): ORF 752; glucose 6-phosphate isomerase
atgagtttaattaaatttgatagtagtaagttaactccatttattcatgaaaatgaattatctgaaatgcaagcaatggttaatgctgctaatgaagaattacgtgatggtactggtgcaggcagcgatttccgcggttggttaaatttgccagttgattacgacaaagaagaatttgaccgtatcaagaaagcagctaagaagatccaatcagattcagatgttttgatttgtattggtatcggtggttcataccttggtgcacaagctgcaattgaattcttgaatagcaatttctacggcaaggaagacaatggcatgccaactgttgtattctgtggtaactcactctcaggttcatacctctatgaccttattgaatgggtaggtgacaaggactttagtattaacgtaatttctaagtcaggtactactactgaaccatcagtagcattccgtatcttcaaggacaagttaatcaagaaatacggtaaggaagaagctgctaagagaatttacgcaactactgaccgtcaaaagggtgctttgaagactgaagctgatgcagaaggctacgaagaatttgtagttccagatgacattggtggtcgttacagtgttcttactgctgttggtttacttccaattgctgcttcaggtgctgatattgatgaattaatgaagggtgcagcagatgctcgtgctgattacactgatactgatttgtcaaaggctactccataccaatacgcagcaatccgtaacattctttaccgcaagggttacactactgaaattgtagaaaactacgaaccaagtttaagaatgtttggtgaatggtgcaagcaattaatgggtgaatcagaaggtaaggatcaaaagggtatttggccatcaagtgctaactttactactgaccttcactcacttggtcaatacatccaagaaggtttacgtaacttatttgaaactgttattcgtgttgaaaatccacgtcatgatgttaagattccaggcgatgaaaagaacttggatcaacttaacttcttggaaggcaagagcttaaactacgtaaacgatcgtgcttacgaaggtgttgttttggctcacactgatggtggtgttccagttatgactattaatattccagatcaaactgcacatactttaggttatatgatttacttctttgaattagctattgctatttcaggttacttgaatggtattaatccattcaatcaaccaggtgttgaagcatacaagcgtaacatgtttggtcttcttaataagccaggctacgaaaacttacacgacgacttagctaagcgtctt

SEQ ID NO: 252 - protein, 445 aa, Lactobacillus acidophilus
MSLIKFDSSKLTPFIHENELSEMQAMVNAANEELRDGTGAGSDFRGWLNLPVDYDKEEFDRIKKAAKKIQSDSDVLICIGIGGSYLGAQAAIEFLNSNFYGKEDNGMPTVVFCGNSLSGSYLYDLIEWVGDKDFSINVISKSGTTTEPSVAFRIFKDKLIKKYGKEEAAKRIYATTDRQKGALKTEADAEGYEEFVVPDDIGGRYSVLTAVGLLPIAASGADIDELMKGAADARADYTDTDLSKATPYQYAAIRNILYRKGYTTEIVENYEPSLRMFGEWCKQLMGESEGKDQKGIWPSSANFTTDLHSLGQYIQEGLRNLFETVIRVENPRHDVKIPGDEKNLDQLNFLEGKSLNYVNDRAYEGVVLAHTDGGVPVMTINIPDQTAHTLGYMIYFFELAIAISGYLNGINPFNQPGVEAYKRNMFGLLNKPGYENLHDDLAKRL

SEQ ID NO: 253 - DNA, 1284 bp, Lactobacillus acidophilus
  CDS (1)...(1284)
  misc_feature (0)...(0): ORF 889; 2-phosphoglycerate dehydratase
atgctcaaatcagttattgaaaatgtacacgcactcgaaatttttgactcacgtggtaacccaactgttgaagttcacgttactctttcaaacggtgtcgtaggtaaggctgaagttccatcaggtgcttcaactggtgaaaacgaagctgttgaattacgtgacggtggttcacgtcttggtggtaagggtgtttcaaaggctgttaacaatgttaacactgaaattaacgacgctttaaagggtatggacccatttgaccaacctaagattgaccaaactatgatcgacttagatggtactccaaacaagggccgtcttggtgctaacgctatcttaggtgtatcaatggctactgctgttgctgcagctaacgctaaccgtcaacctctttaccgttaccttggcggtattgatcttgaaatgccacaaactttccacaacgttatcaacggtggtgaacacgctgacaacggtatcgacattcaagaattcatgattactccaattgctaagacttcattccgtgatggtttcgaaaagatcgttaacgtataccacactttgaagaaggttcttgaagacatgggttacgaaactggcttgggtgacgaaggtggtttcgcacctaacatgaagaactcagaagaagctttgaaggctttacacgaatcaatcatcaaggctggttacaagccaggtgaagatatcggtatcgcatgtgactgtgctgcttcatacttctacaacaaggaagatggtaagtaccaccttgaaggtaaggttcttactgatgatgaattagctgcatactacgacaagcttttggatgaattcccagaattaatgtcaatggaagacccatacgacgaaaacgatgttgaaggtatggttaagtttactgcaactcacaaggaccgtatccaaatcgttcttgacgacttcatttgtactaacccagcacttttgaagaaggctatcaaggaaggtgcaggtaacgcttcattaatcaagttgaaccaaattggtactgttactgaaactcttgaaactatccgtatgtcacgtaagaatggttacaacactatgatttcacaccgttcaggtgaaactggtgacacattcatcgctgacttggcagttgctataaacggtggtcaacttaagaccggtgctccagctcgttcagaacgtgttgaaaagtacaaccgcttacttgaaatcgaagaagaacttggcaagggcgaacgtcttgcattcttcccagatgatgttgaccacgat

SEQ ID NO: 254 - protein, 428 aa, Lactobacillus acidophilus
MLKSVIENVHALEIFDSRGNPTVEVHVTLSNGVVGKAEVPSGASTGENEAVELRDGGSRLGGKGVSKAVNNVNTEINDALKGMDPFDQPKIDQTMIDLDGTPNKGRLGANAILGVSMATAVAAANANRQPLYRYLGGIDLEMPQTFHNVINGGEHADNGIDIQEFMITPIAKTSFRDGFEKIVNVYHTLKKVLEDMGYETGLGDEGGFAPNMKNSEEALKALHESIIKAGYKPGEDIGIACDCAASYFYNKEDGKYHLEGKVLTDDELAAYYDKLLDEFPELMSMEDPYDENDVEGMVKFTATHKDRIQIVLDDFICTNPALLKKAIKEGAGNASLIKLNQIGTVTETLETIRMSRKNGYNTMISHRSGETGDTFIADLAVAINGGQLKTGAPARSERVEKYNRLLEIEEELGKGERLAFFPDDVDHD

SEQ ID NO: 255 - DNA, 960 bp, Lactobacillus acidophilus
  CDS (1)...(960)
  misc_feature (0)...(0): ORF 956; phosphofructokinase
atgaaacggattggtattttaactagtggtggagacgcccctggtatgaatgcagcaattagagctgtgacaaagactgctatccatcatggacttgaagtctttgggattcgttatggtttcgctggtttggttgcaggtgactttattccgcttactacggaaaatgttgaccacaagattagtgaaggcggtactttcttgtacagtgctcgcttccctgaatttgcacaagaagaagtgcaacaaaagggtgttgagcaactaaagaaacatggtattgatgctgttatcgttattggcggtgatggatcatatcatggtgctttagccttaactcgccacggcgtaaactcagttggtttaccaggaactatcgataatgatattccttatactgactacacgatcggctttgattctgcttgtcgtactgctatggatgcgattgacaagattcgcgacacagcaagtagtcaccaccgcgtattcgttgttaatgtaatgggtcgtgaatgtggtgatattgctatgcgtgtaggtgtagctagtggagcagatgcaattgttattcctgaacgtccttatgacgtaaaggaaattgcagaaactattaaacgtggttttgcagatggcaaagatcatggtatcattgtcttggcagaaggcgttatggatgccgaagaatttaaggatgaattacttaaatacggtgattttgatgctcgtgctaatgttcttgcacatatgcaacgtggtggctcaccaactgttgaagatagagtaaatgctactaagatgggtaactatgctgttaacttacttcttgatgggaagggcggtttagctgtcggcatggagaatggtaagttgaatacccacgacattttagatctatttgacagtaagcaccaaggcgacttttcactgctagatgttaatgaagaaatgactaaagat

SEQ ID NO: 256 - protein, 320 aa, Lactobacillus acidophilus
MKRIGILTSGGDAPGMNAAIRAVTKTAIHHGLEVFGIRYGFAGLVAGDFIPLTTENVDHKISEGGTFLYSARFPEFAQEEVQQKGVEQLKKHGIDAVIVIGGDGSYHGALALTRHGVNSVGLPGTIDNDIPYTDYTIGFDSACRTAMDAIDKIRDTASSHHRVFVVNVMGRECGDIAMRVGVASGADAIVIPERPYDVKEIAETIKRGFADGKDHGIIVLAEGVMDAEEFKDELLKYGDFDARANVLAHMQRGGSPTVEDRVNATKMGNYAVNLLLDGKGGLAVGMENGKLNTHDILDLFDSKHQGDFSLLDVNEEMTKD

SEQ ID NO: 257 - DNA, 1767 bp, Lactobacillus acidophilus
  CDS (1)...(1767)
  misc_feature (0)...(0): ORF 957; pyruvate kinase
atgaagaaaactaagattgttagtactttaggaccagcttcaaacgatattgaaactattactgctttagctaacgcaggcgcaaacgtattccgtttcaacttctcacacggtgaccatgaagaacaccgttcacgtatgaacatggttcgtgaagtggaaaagaatactggtaagcttcttggtattgctcttgatactaagggtgctgaaatcagaaccactgaacaagaaggtggcaagtttactatcaatactggtgacacaatccgtatctcaatggacgatactaagaagggtaacaaggacatgatccacgttacctacgacggcttgtacgatgatactcacgttggtggtcacgtattaatcgatgatggtttggttgaccttttgatcaaggaaaaggacgacgctaagagagaattagtttgtgaagctcaaaacactggtttaatcggttcaaagaagggtgttaacgctccaggtgttgaaattcgcctcccaggtatcactcaaaaagatactgatgacattaactttggtttgaaggaaggtatcaactttatctttgcttcattcgcacgtaaggctcaagatatcttagacatccgtaagctttgtgaagcagcaggtgctgactacgtaaagattttccctaagatcgaatcacaagaaggtatcgacaacgctgacgaaattttacaagtttctgatggtttgatggttgctcgtggtgacatgggtgttgaaattccatttatggaagttccatttgtacaaaagaacttaatcagaaaagctaacgcacttggtaagccagttattactgctactcaaatgcttgactcaatgcaagaaaacccacgtccaactcgtgctgaagtttctgacgttgctaacgctgttcttgacggtactgatgcaactatgctttcaggtgaatcagcaaacggtttgtacccagttaacgctgttaaagctatggctgaaatcgatgaacgtactgaaaagcaaatgcttaagcgtaacactttagcacttcaaagatttgaagcatacaagggctcaaacgtaactgaagctatcggtgaatcagttgtacgtactgcacaagaattaggtgttaagactatcatcgctgcaactaactcaggttacactgctcgtatgatttctaagtaccgtccaaatgctgacatcgttgcaatgaccttcgatgaaaagatccaacactcattggcagttgtttggggtgtacaaccagtattaactgacaagcctaagtcaactgatgacatgtttgaaaaggcagcagaagttgctaaggaaaagggctacgttaaggatggtgaccttgtaattatcgttgctggtgttccagttggtgattcaggtactactaacttgatgaagttacaaattatcggtaacaagcttgttcaaggtttaggtgttggtaacggttcagttatcggcaaggctgttgttgcaaactcagcagaagaagctaacagcaaggttaaggaaggcgacatcttagttgctaagactactgatccagactacaacccagctatcaagaaggcttcaggtttggttgttgaagcttcaggtttaacttcacacgcagcagttattggtttatcattaggtatcccagttgttgttggtgctactgacgctactgaaaagatttctgacggttcaactattactgttgatgctcgtcgtggtgctatttaccaaggtgaaatctcaaacctt

SEQ ID NO: 258 - protein, 589 aa, Lactobacillus acidophilus
MKKTKIVSTLGPASNDIETITALANAGANVFRFNFSHGDHEEHRSRMNMVREVEKNTGKLLGIALDTKGAEIRTTEQEGGKFTINTGDTIRISMDDTKKGNKDMIHVTYDGLYDDTHVGGHVLIDDGLVDLLIKEKDDAKRELVCEAQNTGLIGSKKGVNAPGVEIRLPGITQKDTDDINFGLKEGINFIFASFARKAQDILDIRKLCEAAGADYVKIFPKIESQEGIDNADEILQVSDGLMVARGDMGVEIPFMEVPFVQKNLIRKANALGKPVITATQMLDSMQENPRPTRAEVSDVANAVLDGTDATMLSGESANGLYPVNAVKAMAEIDERTEKQMLKRNTLALQRFEAYKGSNVTEAIGESVVRTAQELGVKTIIAATNSGYTARMISKYRPNADIVAMTFDEKIQHSLAVVWGVQPVLTDKPKSTDDMFEKAAEVAKEKGYVKDGDLVIIVAGVPVGDSGTTNLMKLQIIGNKLVQGLGVGNGSVIGKAVVANSAEEANSKVKEGDILVAKTTDPDYNPAIKKASGLVVEASGLTSHAAVIGLSLGIPVVVGATDATEKISDGSTITVDARRGAIYQGEISNL

SEQ ID NO: 259 - DNA, 909 bp, Lactobacillus acidophilus
  CDS (1)...(909)
  misc_feature (0)...(0): ORF 1599; fructose bisphosphate aldolase
atggcttattttgtaaatggtaacgaaatcttcagagaagctcgtaaacaccactacgctgtaggtgcttacaacactaacaacttggaatggactcgtgcagaattacgtgctgcagaagaaactagaactccacttttgatccaagtttcaactggtgctgctaagtacatgggtggctataagttcgttaaggacatggttgaagaccaaatggactcaatgaacatctctgttccagttatcttaaacttggaccacggtgactttgaatcagctaaggaatgtattgcacttggttactcatcagttatgtttgatggtcacgcacttccaactgaagaaaacttggctaagactaaggaaattatcaagttggctcacgaacgcggtatttctgttgaagctgaaattggtaagatcggtgaaaaccaaggcggcggtgaattagcttctgttgaagatgctaaggcattcgttgaagctggtgttgacaagcttgcttgtggtattggtaacatccacggtgtttacccagcagactggaagggtcttaacttcgatcgtttgaaggaaattgctgaagctgttcctgaaactccacttgtacttcacggtggttcaggtattcctgaagaccaaatcaagaaggctatccaacttggtatttcaaaggttaacatcaacactgaattccaattagcattccaagaagcaactcgtaagtacatcgaagaaggcaaggacgaagacaaggctaacaagggttacgacccacgtaagttgttattgccaggtactgaagcaatcactgacaagatgaaggaaatgattgcttggttaggtactaagactatcgatgacgaacttaaggatgctttattcgaccgttcatcattgaacgaagaa

SEQ ID NO: 260 - protein, 303 aa, Lactobacillus acidophilus
MAYFVNGNEIFREARKHHYAVGAYNTNNLEWTRAELRAAEETRTPLLIQVSTGAAKYMGGYKFVKDMVEDQMDSMNISVPVILNLDHGDFESAKECIALGYSSVMFDGHALPTEENLAKTKEIIKLAHERGISVEAEIGKIGENQGGGELASVEDAKAFVEAGVDKLACGIGNIHGVYPADWKGLNFDRLKEIAEAVPETPLVLHGGSGIPEDQIKKAIQLGISKVNINTEFQLAFQEATRKYIEEGKDEDKANKGYDPRKLLLPGTEAITDKMKEMIAWLGTKTIDDELKDALFDRSSLNEE

SEQ ID NO: 261 - DNA, 1299 bp, Lactobacillus acidophilus
  CDS (1)...(1299)
  misc_feature (0)...(0): ORF 1641; glycerol 3-phosphate ABC transporter
atgaagtttagtaagaaacttgctatggctgccgttgctactttggccttagttagtactgctgcttgttcaaatggaggtagtaactcttcatctagttcagagaagattccatcaaagattaacaagaagactactgttgttttctggaatgctatgccaggcgttcaaggttcaactttgaagcaattgaccaatgaatttgaaaagaagaaccctaagatcactattaagttggaaaaccaaggtgcttacaatgatttacaagcaaagattaactcaactttgcaatcaccaaacaacttaccaactattactcaagcatatccaggctggctttggaatgccgcacaaaacaagatgcttgttaacttgactccatacatcaataacaagaatgttggttggggcagtgctaaggcttcaggtattagaacagaacttcttgatggtgctaagatcaagggtactcaatacggtatcccatttaacaagtcaattgaaactttgacttacaatgcagatatgtttaagaaatatggcattaagaaagttccaactactatggaagaacttaagcaagtttcagaaactatttacaagaagagtaaccataaagttgtaggtgcaggttttgattcactttctaactactacactcttggtatgaaggatgaaggcgtaaacttctcagacaagattaactttaatggttcaacttcaaagaaagttattaactactacgcagatggtgttaagaaggggtacttcagaatggctgggtcagaccactacctttcaggtccatttgctaacgaaaaagttgctatgtttatcggtacttcagcaggtgaaggtttcgttaagcaaggtgtaggtaacaagtttacttatgatgttgctcctcgtcctggtaagtacactttgcaacaaggtactgatatttacatgttcaaccacgcaagtgctgatcaaaaggctgcagcatttaagtacattaagttcttaacttctaagtcaagccaacttaagtgggctaacgcaactggttacattccagttaacgacggcgttgtaacttcaagtgcatacaagaacggcaagaatactaagcttcctgctaagcttgaagattcaatgaagaatttatacagtgttccagtttctaagaactcaaatgctgcattccaacaattgaacagtattatgcaaaatattcttgctgcagcacaaaagggtcaaaatattaacagtcaaattgataatggtaaacaaaaatttgatgctgcttggaagcaa

SEQ ID NO: 262 - protein, 433 aa, Lactobacillus acidophilus
MKFSKKLAMAAVATLALVSTAACSNGGSNSSSSSEKIPSKINKKTTVVFWNAMPGVQGSTLKQLTNEFEKKNPKITIKLENQGAYNDLQAKINSTLQSPNNLPTITQAYPGWLWNAAQNKMLVNLTPYINNKNVGWGSAKASGIRTELLDGAKIKGTQYGIPFNKSIETLTYNADMFKKYGIKKVPTTMEELKQVSETIYKKSNHKVVGAGFDSLSNYYTLGMKDEGVNFSDKINFNGSTSKKVINYYADGVKKGYFRMAGSDHYLSGPFANEKVAMFIGTSAGEGFVKQGVGNKFTYDVAPRPGKYTLQQGTDIYMFNHASADQKAAAFKYIKFLTSKSSQLKWANATGYIPVNDGVVTSSAYKNGKNTKLPAKLEDSMKNLYSVPVSKNSNAAFQQLNSIMQNILAAAQKGQNINSQIDNGKQKFDAAWKQ

SEQ ID NO: 263 - DNA, 1008 bp, Lactobacillus acidophilus
  CDS (1)...(1008)
  misc_feature (0)...(0): ORF 452; Mannose; PTS system mannose-specific factor IIAB
atggtaggaattgttttagccagccatggtggcttcgctgatgggattgcgcaatctgcacaaatgcttttcggtgaacaggataattttgcacatgttatcttaaagcctaatgaaggtccagatgatattcgtggcaaaatggaaaaagcaattgcttcatttgataaccaagatgaagttttattcttggtagacttatggggtggtacacctttcaaccaggcaaatggtcttgctgaaaaacatgataaatgggcaattgtagccggtatgaatttaccaatggttgtacaagcattaactgaaagaatgatgaatgctaatgcaactgcacatgaaattgctactgcagttgttgaacctggtaaagatggtatcaagacaaagccagcagatttgatgcctaaatcagctgctgcaccagcagctaaggacgctggcgaagctaagggtaataagaagactattccagaaggcactgttattggtgatggccatattaaatatgttttagcaagaattgattcacgtttacttcatggtcaagttgctactggatggattccagcaatgaaaccagatcgcgttatcgttgtttctgatagcgtagctaaggatgatttgcgtaagagtatgattcgtgaagctgcacctgcaggcgtaaaggctcatactgttccgcttaagaagatggcagaaattgctaaagatccaagatttggtgatactcatgcacttcttttattcgaaaatccagaagacgttttaagagctatcaaagatggtattgatattaaagaagttaacgttggttcaatgtcatacaaggaaggcgatgttaacgccaataatgtattatcaatggaccaaaaggatgttgatacattccgtgaacttgaaaagatgggtgttaagtttgacgttcgaaaagttccttcagacgcaccaggcaatatggatgctatcttaaataaagctcagcacttacttgatgaacaaaagaaa

SEQ ID NO: 264 - protein, 336 aa, Lactobacillus acidophilus
MVGIVLASHGGFADGIAQSAQMLFGEQDNFAHVILKPNEGPDDIRGKMEKAIASFDNQDEVLFLVDLWGGTPFNQANGLAEKHDKWAIVAGMNLPMVVQALTERMMNANATAHEIATAVVEPGKDGIKTKPADLMPKSAAAPAAKDAGEAKGNKKTIPEGTVIGDGHIKYVLARIDSRLLHGQVATGWIPAMKPDRVIVVSDSVAKDDLRKSMIREAAPAGVKAHTVPLKKMAEIAKDPRFGDTHALLLFENPEDVLRAIKDGIDIKEVNVGSMSYKEGDVNANNVLSMDQKDVDTFRELEKMGVKFDVRKVPSDAPGNMDAILNKAQHLLDEQKK

SEQ ID NO: 265 - DNA, 852 bp, Lactobacillus acidophilus
  CDS (1)...(852)
  misc_feature (0)...(0): ORF 1479; beta-glucoside; transcription antiterminator
atgatcgtaataaaaagagtactcaacaacaatgctgtcgttgcaaaagatgaacttaatcgaactttggttgcattaggcagtggtattgcttttcaacaaaaagcagggcatattatcccaaaagataaaatagaaaagattttttatcccaaggatgaagatgcaacaaattcaattagtgaaactttatcacagattgatcctaaatatattgagttgtccgatcgtattatttcagaagctatcacaagttcaggtaaaaaattatcagatgatatttatgtatctttacctgatcatttacagtttgctgttgagagagttaagaatggcattttgattcaaaataaattaactgtcgagacaatgcaaacatatccagatgaatttcagttagggaaacgtgttttaaagtatctatcagaaaaaacgggattagattttcctgatgatgaagcgacaaatattgcaatgcacttaattaccgctgaagaaggagattctttggaaaatactgagggaacgattgaattgataaatcgtttcttaaagataataagtgaaatgttaggaaagaacataaactctaattcagtatcatattatcgtttaattacacatcttaaattctttattcagcgtattaaaaaacagcagagccaaaagtttaaagcagataaagatttatatgacatggttatccatagttatcacaaagaatacattattgctcaaagaattgcaggtattgtattacatgattttaattatgaagtgtcagaagatgaagtgatgtttcttactatacatattcatcgaataaatgtatcaacaggtgactacaatgaa

SEQ ID NO: 266 - protein, 284 aa, Lactobacillus acidophilus
MIVIKRVLNNNAVVAKDELNRTLVALGSGIAFQQKAGHIIPKDKIEKIFYPKDEDATNSISETLSQIDPKYIELSDRIISEAITSSGKKLSDDIYVSLPDHLQFAVERVKNGILIQNKLTVETMQTYPDEFQLGKRVLKYLSEKTGLDFPDDEATNIAMHLITAEEGDSLENTEGTIELINRFLKIISEMLGKNINSNSVSYYRLITHLKFFIQRIKKQQSQKFKADKDLYDMVIHSYHKEYIIAQRIAGIVLHDFNYEVSEDEVMFLTIHIHRINVSTGDYNE

SEQ ID NO: 267 - DNA, 1989 bp, Lactobacillus acidophilus
  CDS (1)...(1989)
  misc_feature (0)...(0): ORF 725; beta-glucoside; PTS system, beta-glucosides-specific IIABC component
atggctaagaactatgatcaattagctaaaaccatcatcaaagatgttggtggcaaagataatgttaatagcgttgtgcactgtgctacacgtttgcgtttcaagttgaaagatgaaaaaaaggctgacgatgatgccttaaaaaatacagacggtgttgttacagtagttaaggctggtggacaatatcaagttgttatcggaaacgaggttgccgatgtatatgatgcagtcttaaaagaaggcggcttctcaggcggtggcgaagttcctgatgactatagtgaagatgataattcaagttttgtcgataaagccgtcgccttaatttcaggtatttttaccgatattttagctccgcttagtgctggaggtatcatcaaaggtttagttgttttagctgcagctatgggttggctttcaacttcatctggtgcatatcaaattttatatgcaattggtgatagcattttttacttcttaccaattttcttgggagtaacggctgccagaagattccacatgaatcaatttattggtttagcaatcggtgctacattgacatacccaacaatggtgcaattagctgcaagtaagactgttttaggaacactttttgctggtacaccatttgcttcacagattcatacgactttctttggtattccagtaattacaatgaattatacttcaactgttttgccagttttattcgcagtttggtttgcttcaattattgaacattggtctaagaagtggattccaagcgtagttcaaatgtttttggtacctgtagttactatgattataactttgccaattgcctttattgtaatcggtcctgtaatgacctgggttgggaatgcaattggtgctgtaatgtcaggtatttaccactttagtccaattattgccggtctacttttaggtggactttggcaagtattggttatcttcggtgttcactgggggatcgttgccgtaactacagccgatttagctgctcttggttatgatccaattttaggtatgacttgcatggtctgctacgcacaaatcggggttgttttagctattattaaacaaaccaaagataagaaacttaaagaaaacgctactggtgcattcttctcaggactctttggtgtaactgaaccagctatttatggtattactttgccaagaaaacgtccatttgttttaagttgtattgctggtgctgtttcaggtgcgattatcggtgccttccattcagttttatacattttaccttcaatgggtttctttgcaattcctgcctacattaaccctaaagggggttcaatgactcaaattatcggcgtaattattgccggagtagttgcttttatagttggttttgctttacaaatgctctttggtaaaaagtcagtagatgcaaaatatgataaaaagcaaactgaaaaagtagaagtaaatgaaactttacaaacgactccagatgttgctactgctacattggctagcccagaaaatggtcaaattatgccactttcagaagttaaagatgacgtattttcaagtggtgcaatgggtaagggaattgctattgaaccaagtgatggggttcttcatgcacctgcagatggtaagatcattatgacctttaagactggtcatgcaattggtatgaaaactaagaacggtgcagaaattttaatgcatattggtatggatactgcgaatcttcaaggtaaaggttttgatactttggtagaaaaagatcaaaaagttaaagctggcgatccattaattaagtttgatattgatttaattaaaaaggctggttaccctgtaaccacacctatggtagtaactaattcacaagactttgatgatattaaacagattgttaaaggtgaagtaaaggtaggacaagctgtactcgaacttgaagctcctgaggcaaaggatgtaactacatcagttaatggacaagtgcaattaaat

SEQ ID NO: 268 - protein, 663 aa, Lactobacillus acidophilus
MAKNYDQLAKTIIKDVGGKDNVNSVVHCATRLRFKLKDEKKADDDALKNTDGVVTVVKAGGQYQVVIGNEVADVYDAVLKEGGFSGGGEVPDDYSEDDNSSFVDKAVALISGIFTDILAPLSAGGIIKGLVVLAAAMGWLSTSSGAYQILYAIGDSIFYFLPIFLGVTAARRFHMNQFIGLAIGATLTYPTMVQLAASKTVLGTLFAGTPFASQIHTTFFGIPVITMNYTSTVLPVLFAVWFASIIEHWSKKWIPSVVQMFLVPVVTMIITLPIAFIVIGPVMTWVGNAIGAVMSGIYHFSPIIAGLLLGGLWQVLVIFGVHWGIVAVTTADLAALGYDPILGMTCMVCYAQIGVVLAIIKQTKDKKLKENATGAFFSGLFGVTEPAIYGITLPRKRPFVLSCIAGAVSGAIIGAFHSVLYILPSMGFFAIPAYINPKGGSMTQIIGVIIAGVVAFIVGFALQMLFGKKSVDAKYDKKQTEKVEVNETLQTTPDVATATLASPENGQIMPLSEVKDDVFSSGAMGKGIAIEPSDGVLHAPADGKIIMTFKTGHAIGMKTKNGAEILMHIGMDTANLQGKGFDTLVEKDQKVKAGDPLIKFDIDLIKKAGYPVTTPMVVTNSQDFDDIKQIVKGEVKVGQAVLELEAPEAKDVTTSVNGQVQLN

SEQ ID NO: 269 - DNA, 1251 bp, Lactobacillus acidophilus
  CDS (1)...(1251)
  misc_feature (0)...(0): ORF 1369; Cellobiose; phosphotransferase system enzyme II
atgcaaaatagtaagttcatgaattggacgaggcaaaagttaatgcctgccttaggaaaaatgggcgaaaacaaatatatggttgttttaagagatgggatgattatttcagttccatttactatcttcggttctatctttatgatcattgccaacttgcctgtgccaggttggtcaaatatcattaagccttatcttccagtattaaatgcgccaattaatatgtctactggtttgattggtttaattattgcacttggtatttcatatactttagcccgtgaaaataagattgatcgtctatctgcatcagtaattggtgctattgcttttattatttgcgaattgaacaataaaatggtccttgatcctacaaacttaggagcttcaagtatgttcactgctatcgttgtttcacttatcggtggcgaaatttataactggtttattaagcataaaattgttattaagttaccggattcagttccacctgcagtagctagttcatttgtctcattaattcctgcattagcaattttaggtggcgcttgggttattagatgtctgcttcatttagatatcaatgcctttattacctggatcttctcacctcttactgctactctgggtagtttctggggaatggaactgtttactttcttcacactttttgcttggactattggtatccatggtaataatactgttggtattgtagctggtcctgtttatggtaattttttaatggacaatatgcataaagctatgaacggtggcgtacccactcacatttgtgctgatggtttcttaacttttggtatggcaatgggtggtaccggtgctgttctcggattagtaatttgtatgttatttgccaaaagtaagcgttataaacaattagctcacttaggtttcgttccatgtattttccaaatttctgagcctattatgtttggtgtccctgttgtattaaatcctacccttgcaattccatttattactattcctttggtattacaagcaatctcttatttcttatttaaattccatatcttacatatgatcattgccagtgttccttggactactccaactttacttaatggtttcttgattactggtggtgattggaaagccgttgtatggcaagctatctgtgtattaatcgcagttgcaggttactggccattcttcaaaattttggataaaaaagctttagcagttgaacaaggcgaaactgctcccgaagaa

SEQ ID NO: 270 - protein, 417 aa, Lactobacillus acidophilus
MQNSKFMNWTRQKLMPALGKMGENKYMVVLRDGMIISVPFTIFGSIFMIIANLPVPGWSNIIKPYLPVLNAPINMSTGLIGLIIALGISYTLARENKIDRLSASVIGAIAFIICELNNKMVLDPTNLGASSMFTAIVVSLIGGEIYNWFIKHKIVIKLPDSVPPAVASSFVSLIPALAILGGAWVIRCLLHLDINAFITWIFSPLTATLGSFWGMELFTFFTLFAWTIGIHGNNTVGIVAGPVYGNFLMDNMHKAMNGGVPTHICADGFLTFGMAMGGTGAVLGLVICMLFAKSKRYKQLAHLGFVPCIFQISEPIMFGVPVVLNPTLAIPFITIPLVLQAISYFLFKFHILHMIIASVPWTTPTLLNGFLITGGDWKAVVWQAICVLIAVAGYWPFFKILDKKALAVEQGETAPEE

SEQ ID NO: 271 - DNA, 1323 bp, Lactobacillus acidophilus
  CDS (1)...(1323)
  misc_feature (0)...(0): ORF 227; Cellobiose;PTS cellobiose-specific component IIC
atgaaaaactttattaacacgcgcgtcttaccgccgataatgaaatttgttaacacaagaccaatcgttgcattaaaagatggtatggttatatctttgccatttattatgatcggttcagtatttttacttcttgcttcatttccagttccagcagttgctaactggatggatgcaatggggttaactagattctggacgcaagcttataatgcttcatttggaattgtttcagtatttgcagtaattggtattgcatatcaatgggcaaaaagtgaaaaagtagatccacttccatcaggattaaccgcatttgttggctttttaattattatgaatccgactagcgctgtaatgaatggttcaaaaactattgtttcagctaatcaagcacctaatttattaagtggctatattgatcgcgtttggcttggtggtcaaggtatgattgccgcaattattattggtttgattactggatggatttattcatggtttattaagaaaaagattaccattaagttaccagatcaagttccaccagcagtagcaggttcatttgttgctttgattccagcggcagttatttccacattatggctatgtgtatacattttctttgaaaaagttgctaacactacattgactcaatggatctatgctactatccaaacaccacttcaaggtatttcagattcattcggtggtatcttgattatgactattttagtaccattcttttggttctttggtgttcatggttcaacacttgttggtggtattgttggtccaattttacaagctaatgcattggaaaatgctgctatttttaagaaatttggctatgtagatgcagaacacggtggtcacattgttattcaggggttatttgatcaattttctactgtaactggtgcaggaatgactattggacttgttgtattcatggtcttctttgctagatcacaacaacttaagagtattggtaaattaaccttggtgccaggtatctttaatattaatgagccggttttgttcggtgttcctattgttatgaacccaatgttggctattccattcttcatcatgccacctttatcagcaggttcaacttacttattaattaaagctggtattctaccataccttaacggtgtacaagtaccatggaccactccaccagttatttcaggattcttaattggtggatggaagatagctctttggcaggcaataattttagtaatttccttctttgtttattggccatttgctcgaagctatgacaagatgctctacaagcaggaacaacaagctaaaaaa

SEQ ID NO: 272 - protein, 441 aa, Lactobacillus acidophilus
MKNFINTRVLPPIMKFVNTRPIVALKDGMVISLPFIMIGSVFLLLASFPVPAVANWMDAMGLTRFWTQAYNASFGIVSVFAVIGIAYQWAKSEKVDPLPSGLTAFVGFLIIMNPTSAVMNGSKTIVSANQAPNLLSGYIDRVWLGGQGMIAAIIIGLITGWIYSWFIKKKITIKLPDQVPPAVAGSFVALIPAAVISTLWLCVYIFFEKVANTTLTQWIYATIQTPLQGISDSFGGILIMTILVPFFWFFGVHGSTLVGGIVGPILQANALENAAIFKKFGYVDAEHGGHIVIQGLFDQFSTVTGAGMTIGLVVFMVFFARSQQLKSIGKLTLVPGIFNINEPVLFGVPIVMNPMLAIPFFIMPPLSAGSTYLLIKAGILPYLNGVQVPWTTPPVISGFLIGGWKIALWQAIILVISFFVYWPFARSYDKMLYKQEQQAKK

SEQ ID NO: 273 - DNA, 1293 bp, Lactobacillus acidophilus
  CDS (1)...(1293)
  misc_feature (0)...(0): ORF 502; sugar transporter; ABC transporter substrate-binding protein
atgaaaaaatggaaattaggagttgcagccattgcaactgtcgcagctttgtcactaactggctgtagtaataatagtcaaagtggcagtagtaacaacaaaaacgttactatgtgggttcacttttctaatactgatccggaaggtaaagcattacaaaagaatatcaatgactttaataaagagaataagcatggctataaagcaaaagttcaatatattcctcgttctggttcaggtggcggctatgaagataagatcaatgctgctttaaactcaggaagtttaccagatgttttaactttggatgctcctaacacagcagcttatgcacattcaaaaattattcaaccaatcgataagtacattactaataaagacgatattctaccaactattattaagcaaggtacttataaaggtaagttatatgctgctggctattcagaatcaagcatcggcttctattacaacaagaagatgttcaaagaggctgggattaaagattcagaaattgctactttacagcatccatggacttggactcaatttaaagatatttgtaagagacttaaaaaccacttccatgaaccagcaattaatatgaacttgaatgaccactcagaaatggctctttattcattagcaccatttgtatggtcagctggtggtagcattactaatcctgctggcacaaaggcagttggctactttaattccaagcaaactacttcagccttccaattaattcaagacatggtcaaagatggttacactactatttcaccaaaggataaaggttttgaaactggcaaatatgccatgatgatgactggtacttgggaagttcaaactttgcaaaaccaatacaagaatttgcaatggggcgtaatgccatatcctgtatctccagctactcacaaagaggtttcaccaacaggctcatggcaatacgcaatgtcttctgcagctaagaacaagaaggcagctggtgctttgattaacttcttaatgagtaagaagtgtatgtaccgcagcgatatggctaacactgttttgccagcacgtaagagtgtatctaagatgatgatgcctaaagttaatgaacaaatgagattcttcattaagcaaaaccaaactacgggtcatgctcgtccagttttagttaactacccacaagtaactagaacatttgctgatactgttcaaaatgtaactttgtacaagaagaatcctaatgtacaaaaggtaatgaacgaacaagctaaagttattcaaaagtaccttgagaaa

SEQ ID NO: 274 - protein, 431 aa, Lactobacillus acidophilus
MKKWKLGVAAIATVAALSLTGCSNNSQSGSSNNKNVTMWVHFSNTDPEGKALQKNINDFNKENKHGYKAKVQYIPRSGSGGGYEDKINAALNSGSLPDVLTLDAPNTAAYAHSKIIQPIDKYITNKDDILPTIIKQGTYKGKLYAAGYSESSIGFYYNKKMFKEAGIKDSEIATLQHPWTWTQFKDICKRLKNHFHEPAINMNLNDHSEMALYSLAPFVWSAGGSITNPAGTKAVGYFNSKQTTSAFQLIQDMVKDGYTTISPKDKGFETGKYAMMMTGTWEVQTLQNQYKNLQWGVMPYPVSPATHKEVSPTGSWQYAMSSAAKNKKAAGALINFLMSKKCMYRSDMANTVLPARKSVSKMMMPKVNEQMRFFIKQNQTTGHARPVLVNYPQVTRTFADTVQNVTLYKKNPNVQKVMNEQAKVIQKYLEK

SEQ ID NO: 275 - DNA, 1440 bp, Lactobacillus acidophilus
  CDS (1)...(1440)
  misc_feature (0)...(0): ORF 507; gtfA
atgaaattacaaaataaggcaatattgataacttatccagatagtttaggtcataatttgaaggacttggatcatgtaatggatcgctattttaataaaacgataggtggtattcatttattaccatttttcccttcaaacggtgatcgcggtttttctcctacaagatatgatgtagttgagcctaagtttggttcatgggaagatgtagaaaagttaagtcaaaagtattatttgatgtttgactttatgattaatcatctttctaaaaaatcctcatattttgaagattttgaagccaagcacgataaaagcaaatatagcgatcttttcttaagttgggataaattttggccaaagggcagaccaactaaagaagatatagatttaatttataaacgaaaagataaggccccatatcaaaatattaaatttgaagatggtactcatgaaaagatgtggaatactttcggcccagatcaaatggatttggatgttagaaccaagacaacacaagattttataaagcataatttacaaaatctttctaaacatggtgctagtttgattcgtttagatgcatttgcttatgcaattaaaaagttagatacaaatgacttctttgtagaaccggaaatttggaatttactcgaaaaggtaaatgattatcttaaagatactccaactactattctgcctgaaattcatgagcattatacgatgccatttaaggtggcagaacatggatactttatttatgattttgctttaccaatggtattgttgtattcactttatagcggtaatagtactcaacttgctgcttggctaaagaaatgtccgatgaagcaatttactactttagatacccacgatggattaggcgtagttgacgcaaaggatattcttacggacgatcaaattagctacacaacaaacgaactttataaaattggtgctaacgtcaagaagaaatattctagtgctgaatatcataatttggatatttatcaaattaatactacttattattctgcattgggtaatgatgataaaaaatattttattgcacggttattacaaatctttgcccctggtattccacaaatttattatgttggattgttagcaggagaaaatgatattcaattattagagaagacaaaagaaggacgcgatattaatcgccactattatgatttggatgagattgcggaacaagttcaaagacctgtagtaaaatctttgattaagttattggaatttcgtaattctgtacctgcatttgatttggaaggttcaatcaaagttgaaactccaagtgaacatgaaattattgtcactagatcaaataaggcaggaacagaagtagctagtacgtacgtagactttaagaacttagactatcaagttaaatacaatgatcaggtctttaatttt

SEQ ID NO: 276 - protein, 480 aa, Lactobacillus acidophilus
MKLQNKAILITYPDSLGHNLKDLDHVMDRYFNKTIGGIHLLPFFPSNGDRGFSPTRYDVVEPKFGSWEDVEKLSQKYYLMFDFMINHLSKKSSYFEDFEAKHDKSKYSDLFLSWDKFWPKGRPTKEDIDLIYKRKDKAPYQNIKFEDGTHEKMWNTFGPDQMDLDVRTKTTQDFIKHNLQNLSKHGASLIRLDAFAYAIKKLDTNDFFVEPEIWNLLEKVNDYLKDTPTTILPEIHEHYTMPFKVAEHGYFIYDFALPMVLLYSLYSGNSTQLAAWLKKCPMKQFTTLDTHDGLGVVDAKDILTDDQISYTTNELYKIGANVKKKYSSAEYHNLDIYQINTTYYSALGNDDKKYFIARLLQIFAPGIPQIYYVGLLAGENDIQLLEKTKEGRDINRHYYDLDEIAEQVQRPVVKSLIKLLEFRNSVPAFDLEGSIKVETPSEHEIIVTRSNKAGTEVASTYVDFKNLDYQVKYNDQVFNF

SEQ ID NO: 277 - DNA, 1476 bp, Lactobacillus acidophilus
  CDS (1)...(1476)
  misc_feature (0)...(0): ORF 1483; rbsA; ribose ABC transporter ATP binding protein
atgaaaattgaattgaatgatattaaaaaaaattttggtactaataaagtattaagaggtgtggattttaaagttaattcaggagaagttcatgctttaatgggagaaaatggtgctggaaaatcaactttaatgaatattttaacaggtctattaaaaaaagatgctggttcaattaaagttgacggacaagaaacaacatatgcgaatgcactggacgctgaacatcatggtatcagttttattcatcaagaaatgaataatttcccagaaatgagcgttgtagataacatttttttaaataaagaaattaaaaataaattcggcttgatgaatcaaaaattaatgaagaagaaggcaaaagcatatttagataaattaggttcggatatagatgtagatatgaagattggcaacttgacagtgggacaacaacaaatgatcgagattgctaaatctttaatgacaaatgcaaaaataataattatggatgaaccaacagcagcattgactgaaaatgaaacagatattttgtttaaaactattcgtgaattaaaaaaacaaaatgtaggatttatatatatttcacatagaatggaagaattatgggaaatatgtgatcgagtaacagttatgcgagatggtatatctatcaatacgtataatacaaaagacgtaaaagaagataaaattgttcatgatatggttggtagagatataggtgattactatccagaaagaaaaccaaaattaggccctgtagccttaaaagctgaaaatttgtcaggggaaaaattccataatatctcttttgaagttcatgagggtgaaattcttggattttctggcttgatgggcgctggtcgtacagaaacaatgagagctttgtttggaatagataaacttactagcggaaaaatttatcttgaaggaaaagaggtaaagctaaatagtcctagtgattctattaaacatggtattggttttttaactgaagatagaaaaaatgagggattagtattagatcaatctttagaagataatattgctttaccaagtattgatggttttagaaaacatggaattattgatcaaaaagcagaagataaatttgctgagatgctgatgaaacgtttaactgtaaaagcacaaagtgcagatgtttctgcaagaagtttatcaggaggtaatcaacaaaaagttgttttagctaaatgggtaggaagcggatcaaaagttttaattttggatgaaccaactcgaggtgtagatgttggtgctaaaaaagaaatttatgaattgatgaatcaattaactgacagacatgtagcaattattatggtttcaagtgatttgcctgaagtgttaagtatgagtgacaggattgaagttctatatgaaggaaaacagatgggagttgttgatgcaaaaggtgccactcaggagcaagtaatgaaactagctacgggaggaaag

SEQ ID NO: 278 - protein, 492 aa, Lactobacillus acidophilus
MKIELNDIKKNFGTNKVLRGVDFKVNSGEVHALMGENGAGKSTLMNILTGLLKKDAGSIKVDGQETTYANALDAEHHGISFIHQEMNNFPEMSVVDNIFLNKEIKNKFGLMNQKLMKKKAKAYLDKLGSDIDVDMKIGNLTVGQQQMIEIAKSLMTNAKIIIMDEPTAALTENETDILFKTIRELKKQNVGFIYISHRMEELWEICDRVTVMRDGISINTYNTKDVKEDKIVHDMVGRDIGDYYPERKPKLGPVALKAENLSGEKFHNISFEVHEGEILGFSGLMGAGRTETMRALFGIDKLTSGKIYLEGKEVKLNSPSDSIKHGIGFLTEDRKNEGLVLDQSLEDNIALPSIDGFRKHGIIDQKAEDKFAEMLMKRLTVKAQSADVSARSLSGGNQQKVVLAKWVGSGSKVLILDEPTRGVDVGAKKEIYELMNQLTDRHVAIIMVSSDLPEVLSMSDRIEVLYEGKQMGVVDAKGATQEQVMKLATGGK

SEQ ID NO: 279 - DNA, 393 bp, Lactobacillus acidophilus
  CDS (1)...(393)
  misc_feature (0)...(0): ORF 1484; ribose permease RbsD
atgaaaaaaactggaattttaaattcagatatttctagagttgttgctgatatggggcatatggattggttaggaattggtgatgctggcacaccggttccaaaaactacagaaaaaattgatttggctgttagtgcaggaatgccatcttttataagtgttttgaaagaagttttaaaagagttacaagttcaaaagatttatgttgcagatgagataaaggatagcaatcctaaacaattagaaaatataaagagaattttaccggatgttgaaattaaatttattcctcatactcaattaaagaaaaatttaagcgaagcaaaagcttttattagaactggagaagaaactcccttttctaacgtaattcttgagagtggcgttatattt

SEQ ID NO: 280 - protein, 131 aa, Lactobacillus acidophilus
MKKTGILNSDISRVVADMGHMDWLGIGDAGTPVPKTTEKIDLAVSAGMPSFISVLKEVLKELQVQKIYVADEIKDSNPKQLENIKRILPDVEIKFIPHTQLKKNLSEAKAFIRTGEETPFSNVILESGVIF

SEQ ID NO: 281 - DNA, 1464 bp, Lactobacillus acidophilus
  CDS (1)...(1464)
  misc_feature (0)...(0): ORF 552; multidrug transporter
atgaataaaaagcaaattatgatggttacgattgcgctaatgctaggaaatgttatgtcgggtcttgatggaacgattattaatacagctattccagcgattgttgctgcattacatggaattcaatttatgggctggattgtagcgatctttttgttaggaatgtcaatttctatccccatttggactaaagtaggagaaaagattactaacaagcgtgcatttgaaatttcgttggtcttatttgtagttggatcaactttgcaaggtatagctcctaacattattttcttcttatgttctcgatttatcatgggtattggtgccggcggtatggggtctctaccttacataattgctggttatgtttttaaaaatattaagactagaactaaggtgttaggatatttaactgctagttggaatggggctgctattttaggaccacttattggtgggtggttaattgatgctttttcatggcactgggtattttatattaatattccaattggattattagcaattattatctgcttggtttactacaaacctgttacaccagaaaagacaccagttttcgatatccctggtgcaagcttgttagttgtcagtttgttacttttcttaatgggtgtccaactcgttgggttaaccgctaactggattgtgattagtctaatcattgtcagcgtggtatttattattttattctttattcgggaaactcatgctgaaaatccgattattccgatatctttgtttaaaaacaaaaatcttgatggtgattttcttttatttgcctttacttggggagcatttattgctgttaacacttacttacctatgtgggcacaggcccttcttggcttatcagcccttcttggcggaatgactttaattcctaattcaattgtggagattattgcttctcaaagtgtagcggctattcaagagaaaatgacaacttttatgttggctcttattggtattattgctatgcttatttcttccggcggcttatacttagcagatttgcatacaccaattcaatttttaacttttattggtgctttttcaggaatcggagttggctttatcttcgttgctttgcaattaaaggtgcagcttgatgctggtcttaagaatatggcaacggctacttcaacttcatatttgattagaattttagctcaaacggtaatggccgcagtatatggcgtaattatgaacttgaatttagcaagcggcgttcatactcatcctggcattacaatggcaatgatgaataagttgagtgatgccaaaagtgctagattgttgccacagagtttggtgccaacaatgagaagtattttccattctgggattaaagaaattatgctagtttctgtggtcttgttggtgattgctttggtgttgaactgctactttaacttcggtaagaaacaaaagaaattacag

SEQ ID NO: 282 - protein, 488 aa, Lactobacillus acidophilus
MNKKQIMMVTIALMLGNVMSGLDGTIINTAIPAIVAALHGIQFMGWIVAIFLLGMSISIPIWTKVGEKITNKRAFEISLVLFVVGSTLQGIAPNIIFFLCSRFIMGIGAGGMGSLPYIIAGYVFKNIKTRTKVLGYLTASWNGAAILGPLIGGWLIDAFSWHWVFYINIPIGLLAIIICLVYYKPVTPEKTPVFDIPGASLLVVSLLLFLMGVQLVGLTANWIVISLIIVSVVFIILFFIRETHAENPIIPISLFKNKNLDGDFLLFAFTWGAFIAVNTYLPMWAQALLGLSALLGGMTLIPNSIVEIIASQSVAAIQEKMTTFMLALIGIIAMLISSGGLYLADLHTPIQFLTFIGAFSGIGVGFIFVALQLKVQLDAGLKNMATATSTSYLIRILAQTVMAAVYGVIMNLNLASGVHTHPGITMAMMNKLSDAKSARLLPQSLVPTMRSIFHSGIKEIMLVSVVLLVIALVLNCYFNFGKKQKKLQ

SEQ ID NO: 283 - DNA, 1203 bp, Lactobacillus acidophilus
  CDS (1)...(1203)
  misc_feature (0)...(0): ORF 567; multidrug transporter
ttgaaagaaaaacccatttggaagcgtaatttatctgtcttatcaattgcggtctttattgcagggatcgctttttcagaaattatgccttttttatcgttatacattaacacgttaggtaatttctctcaccaacaacttagtttctggtctgggatagtttattctggtacgttcattgtttcagcaatcgtctctccttggtggggcaaattagctgataaaaaaggacgcaagccgatgatcttacgagctggaattggaatgtcgcttgtaatagctagtatgggactagtgcaaaatgtttggcaactacttttactcagaatgttgcaaggggtatttgccggttttatttccaactccaatgcgttagtagctaccgaaacacctaaaataaattctggccaggctttagggactatcgcttcagctaccactgccggaactttgcttggaccgcttgttggtggtgctttaacttctattttttcataccgaattacctttatgatcactggcggcttgcttttaatctgctcaattttagtattattctttgttcatgaagatgacttcaagccagtcactactaaaaaattggataaagcaagtggtgtaatcaagtcgcttcgttcacctcatttaatttttggcttattattaaccaccttaattattcaagcagctaacaattcaattaatccaattgtttcactctatgtacgtcaattacttaatgaccacggcaatgttgtttttatttccggtatcattgctgctcttcctgggattgccacatttttagtagcatcccactttggcgcacttggtgataaaattggcactcataaaatcattgttgccggcttcatcgcagcatcaattttctttttcttaacggcttttgtacaaaacacagtcgaattaggaattttgcgctttttggttggcttttctgatgcttgcttattccctcaagttcaaacgatgttaactaaaaactctcctgccgctgtaacgggtcgtattttttcatggaatcagtcagccatgtatattggaaatattgtgggcccgctactaggatcatttgtatcagggatgtttaactatagtatggtctttattgtcactacagtaattgtgctgatcaatctacttcttttcagaatcaatgtcattcaaaatttggcaaaaaaa

SEQ ID NO: 284 - protein, 401 aa, Lactobacillus acidophilus
MKEKPIWKRNLSVLSIAVFIAGIAFSEIMPFLSLYINTLGNFSHQQLSFWSGIVYSGTFIVSAIVSPWWGKLADKKGRKPMILRAGIGMSLVIASMGLVQNVWQLLLLRMLQGVFAGFISNSNALVATETPKINSGQALGTIASATTAGTLLGPLVGGALTSIFSYRITFMITGGLLLICSILVLFFVHEDDFKPVTTKKLDKASGVIKSLRSPHLIFGLLLTTLIIQAANNSINPIVSLYVRQLLNDHGNVVFISGIIAALPGIATFLVASHFGALGDKIGTHKIIVAGFIAASIFFFLTAFVQNTVELGILRFLVGFSDACLFPQVQTMLTKNSPAAVTGRIFSWNQSAMYIGNIVGPLLGSFVSGMFNYSMVFIVTTVIVLINLLLFRINVIQNLAKK

SEQ ID NO: 285 - DNA, 1221 bp, Lactobacillus acidophilus
  CDS (1)...(1221)
  misc_feature (0)...(0): ORF 1471; multidrug transporter
atgaacgttgaagaactaaaaaaatccaataagcataattggaaattaaaaattggaattctaggaatatctttattcttacaagttgcgggctctaacttggcagcaattccaatgattgctaaatcgtttccaaaagaatcagtaacttcgattcaagctttgtttacgattccatcgtttactattatgctttttattttatttagtaatgcggttattaaatgggtaggtaagcgtaacacagttattattggtatgattgccacaactatcggtggtgtaatgccattctttatcaataactttccattaattgtatttagtagattattagttggtgccggtatcggtttgtttacttcattagctgtatcacttatcggtgattgcttcagtggtgatgaacaaaagactttaattggtatccaaggggcaatgggaactttaggaaacagtgcatgtacttttatttctggtttacttttagggattaattggcaaactacattcctttatatgcttctcgtaattcctttcttaattttatttatgatgggatatacaagaaaaatggaaaagcaaactactgttgaaaagaatgatactaaagcaaataccaaagaaaaaagccatgctaaaattcctggcagaatttatattgcattcttcatgctgtttctatacttttcagcatttatggtcgaagcaacagcgtcagctttagtaattcaacaaaaccaacttgctaaccaaggagtattatctactgaaatagccgttgcaggattaattggtgctgtaatttcaatgggatacagtagaatatataaattattccataattacacaccagtaattactactatctgtggagctctcggatttatagtatgttcacaagcaagtaatatggcaattttctttgtgggattgttattaatgtttgtaagttcattaattattccatatgtatatgacactattttaagcgatgttgattcatctattagtaatttgattatttcgattgcacaagtatgtaacaacttaggtgctttcgcatccccatatgtcatcgcattcttaagtaatgtatgtcatttatctactcctgtggatcagatgagaataagtgcaggaattttattagtaattacaattgtattctttgcaatggctgttactcacaagaaagttaatacagttactaaagtagat

SEQ ID NO: 286 - protein, 407 aa, Lactobacillus acidophilus
MNVEELKKSNKHNWKLKIGILGISLFLQVAGSNLAAIPMIAKSFPKESVTSIQALFTIPSFTIMLFILFSNAVIKWVGKRNTVIIGMIATTIGGVMPFFINNFPLIVFSRLLVGAGIGLFTSLAVSLIGDCFSGDEQKTLIGIQGAMGTLGNSACTFISGLLLGINWQTTFLYMLLVIPFLILFMMGYTRKMEKQTTVEKNDTKANTKEKSHAKIPGRIYIAFFMLFLYFSAFMVEATASALVIQQNQLANQGVLSTEIAVAGLIGAVISMGYSRIYKLFHNYTPVITTICGALGFIVCSQASNMAIFFVGLLLMFVSSLIIPYVYDTILSDVDSSISNLIISIAQVCNNLGAFASPYVIAFLSNVCHLSTPVDQMRISAGILLVITIVFFAMAVTHKKVNTVTKVD

SEQ ID NO: 287 - DNA, 567 bp, Lactobacillus acidophilus
  CDS (1)...(567)
  misc_feature (0)...(0): ORF 1853; multidrug transporter
ttgactactacaaaatcaactgcctttccagctggatggcataaagctttttataccttatggttaggctgttttattacaggaatgggctactcaatgacgatgccctttatttctttatttatttctgatctgggtaattatacaaaatttcaaattaatctttactcaggtttagcatttgccatgacatttattgcccaggcaattgtttcaccatattggggcaacttggctgaccgtaaaggtagaaaattaatgtgtatgcgtgcttcaggggttatggcattaactattaccctgactggtttagcaccaaacgctatatatatcgttgttatgcgttttattcaaggagcattttctggttatatcaataatgcaacagcattaatggctggagaaactcctcatcacagaagcggctgggtaatgagccaaatgatgatagccggaactgcaggtaacttagttggaccacttttaggcgtgctttatcaagtttctttggcaattggctcggcggtgcttggggatatcgtattccattctttattaccggattat

SEQ ID NO: 288 - protein, 189 aa, Lactobacillus acidophilus
MTTTKSTAFPAGWHKAFYTLWLGCFITGMGYSMTMPFISLFISDLGNYTKFQINLYSGLAFAMTFIAQAIVSPYWGNLADRKGRKLMCMRASGVMALTITLTGLAPNAIYIVVMRFIQGAFSGYINNATALMAGETPHHRSGWVMSQMMIAGTAGNLVGPLLGVLYQVSLAIGSAVLGDIVFHSLLPDY

SEQ ID NO: 289 - DNA, 1929 bp, Lactobacillus acidophilus
  CDS (1)...(1929)
  misc_feature (0)...(0): ORF 1012; treB; beta-glucoside; beta-glucoside-specific PTS system IIABC component
atgaatgaaaacaatgaaattgcaattctcgctcccgcaagcggtgaagtaattgcattaagtaaaacaagtgatccaatctttagtaaaggtgcaatgggacaaggatttggtcttacaccatctgatggtgaagttgttgcaccaataagtggaaaagtttcaatgattgcagatactaaacatgctattggaataaccacagatgatgggcttgaagtattagttcacatgggagttgatacagttagtcttaagggagagccttttgaagttttagttaaaaatggtcaaactattgaagccgggcaagatattgccacaatgaatcttaaagccattaaaagtagcaatcttgatactaccattatggttttaatcacaaactcaaatgataagcttgagggtttagacgtttctgaaggtcctgctagaactggcgacgttatagctcatgcatacctaaaagtagaacaaaagaatacctcaaatcaaaagctttcatatgatgaactggcaacttttatcataaaaaatgttgggggcaaagataatattaacaatttaattcactgtatcactcgtctacgcttctacttgaaagatgaaagtaaagctaatgacgaagcattaaagaatcaacgtggtattcttgatgttatgcatgctggtggtcaatatcaagttgttatcggaaatgaagttactaatgtttatgatgcagtaatgaaacagcttcctaatttaagtgatcaacctgctccacaaactaatgaaaatgatgaccgtaatcctgtttcaaaggcatttggcaacttgatcggctttattactggttcaatgagtccagtaattggcgtaatcgctgcatcaggtattattaaaggatttttggctttactcactcttccacaacttggagcattattaaacgttaaaagtcctgtctatataacagttagtgcaatggctgactcagcattcttcttcctaccaattttagttggattctcggctgctaaacgacttaatagtgatccaattattgcagctgtaattggtggttttattacttatccccaaatgattagttggggtactgcgggtaagatgatgtttaatctaggtaattggaacttccaattcttaaactacagttactcaatctttccaatgatcttggctgcatggcttgctgctaaatgcgaagattggcttaagaaaattttaccaagctatttacaaatgattttcgtaccattaattactattttagctgtatcaaccatcactttagtaattacggggccagttattcaaggtgctgctaacggcatcgcagtatttattaattggttagtatcatcatcaggttggatcggcggcttagtaatcggtgccttttaccaactacttgttatcttcggtcttcactggggtgttgtaccactggtcgctcaacaaattgcttctactggtcaaagttcattaaatgcaattatttgttcaactatgatcgctcaaggtgctgccgttttagctgttgcagttaagtcaaagaaggctgacatgaaagaattaggtattgcagctgctatctcagcattctgcggtgttaccgaaccagcgatttatggaattaacttaagatacaagaaagtttttgcttcaggctgtgtcggttcagcatttggtggtcttgtaaccggtcttatgcatggtacaatgtacggttttactggtggtctaattggattttctagtttcttcaatccggctcatcctactcaactaaacagtttctacacattcttaatcgctagtgctgtttctattgtggttgcattcattgttacctgggtttggggctataatgataatatgaccatgggtaaaaaagttgaaaagaaacaacgtccaggtactaag

SEQ ID NO: 290 - protein, 643 aa, Lactobacillus acidophilus
MNENNEIAILAPASGEVIALSKTSDPIFSKGAMGQGFGLTPSDGEVVAPISGKVSMIADTKHAIGITTDDGLEVLVHMGVDTVSLKGEPFEVLVKNGQTIEAGQDIATMNLKAIKSSNLDTTIMVLITNSNDKLEGLDVSEGPARTGDVIAHAYLKVEQKNTSNQKLSYDELATFIIKNVGGKDNINNLIHCITRLRFYLKDESKANDEALKNQRGILDVMHAGGQYQVVIGNEVTNVYDAVMKQLPNLSDQPAPQTNENDDRNPVSKAFGNLIGFITGSMSPVIGVIAASGIIKGFLALLTLPQLGALLNVKSPVYITVSAMADSAFFFLPILVGFSAAKRLNSDPIIAAVIGGFITYPQMISWGTAGKMMFNLGNWNFQFLNYSYSIFPMILAAWLAAKCEDWLKKILPSYLQMIFVPLITILAVSTITLVITGPVIQGAANGIAVFINWLVSSSGWIGGLVIGAFYQLLVIFGLHWGVVPLVAQQIASTGQSSLNAIICSTMIAQGAAVLAVAVKSKKADMKELGIAAAISAFCGVTEPAIYGINLRYKKVFASGCVGSAFGGLVTGLMHGTMYGFTGGLIGFSSFFNPAHPTQLNSFYTFLIASAVSIVVAFIVTWVWGYNDNMTMGKKVEKKQRPGTK

SEQ ID NO: 291 - DNA, 1662 bp, Lactobacillus acidophilus
  CDS (1)...(1662)
  misc_feature (0)...(0): ORF 1014; treC
atgattaatttaggcaaaaaaataatttatcaaatttatcctaaatctttctatgattcaaatggcgatggggtaggagatcttcaaggaatcattcaaaagattgattatattaagaagttaaatgtagacatgatctggtttaatccattttttgtttcaccgcaaaatgataatggttatgatattgctgattattacaacattgatcctcgctttggtacaatggctgattttgagaaattggtaaagaagctgaaagaaatcggtgtgggtgtaatgctagatatggtgctcaatcactgctcaactgaaaatatttggtttaaaaaagcacttgctggcaatgaaaagtatcgtaaatttttctacttgagaaaaggaaaaaacggaggtttacctaataattggcaaagtaaattcggtggtactgcttggtcaaaatttggtgataccgattactactaccttcacttgtatgatccaactcaagcagatcttgattggcataatcctgaagttcgtaaagaattatttaaagtggttaacttttggcgtagtaaaggtgtccatggcttccgctttgatgtaattaatgttacgggtaaagcggaaaaactagttgattcaacagatcctgtagaagaaaagagtttgtacactgatactccaattgttcataaatacttaaaagagcttaatgctgcaacttttggtcaagaccctgaatcaattactgtgggagaaatgtcatcaacgacgattgccaactcaattgaatattcaaaaccaagtgaacatgaattatcaatggttttcactttccatcatttgaaagttgactatcaggatggtgaaaagtggtctaagatgccatttgattttatgaaattaaaggaattattcactgaatggcaagaaaaaatggatcaaggtgatggctggaacgcattattctgggacaatcatgatcagccttgggcattaactagatttggtgatactggtaagtatcgtggaaagtcagctgaaatgcttgccacagcaactcatcttatgcggggaacaccatatatttatatgggtgaagaaattggtatgattgatcctgattattcttcaatggatgattacgtagatgttgaggccaagaatgcttttaaggctttaactaaaaaaggtttgagtgataaagaagcttttgaaatagttaaatcaaaagctcgtgacaattcacgtgtaccaatgcattggaatagtgaaaaatatgcaggttttagtgaacataagccgtggctcataccaactgatcaagaaaaaattaatgttgaagaggaattagcacatggtgaaatttttaattactatcaaaagttaattaagctgcgtagaagcgaagatttaatctctgatggtcatattaagatgttcttgaaagatgatccgcaggtttttgcttatgaacgctacttaaaagatagtgataaaaagttattggtatttactaacttctatggtaaagaacatagtgttaaattacccgaagaatatcaaaacaaagaataccaagttttaattaacaattatgatactaaagatagccaattaaccgatgaaattatattgaagccatatgaagcattagctattaaaattaaacaa

SEQ ID NO: 292 - protein, 554 aa, Lactobacillus acidophilus
MINLGKKIIYQIYPKSFYDSNGDGVGDLQGIIQKIDYIKKLNVDMIWFNPFFVSPQNDNGYDIADYYNIDPRFGTMADFEKLVKKLKEIGVGVMLDMVLNHCSTENIWFKKALAGNEKYRKFFYLRKGKNGGLPNNWQSKFGGTAWSKFGDTDYYYLHLYDPTQADLDWHNPEVRKELFKVVNFWRSKGVHGFRFDVINVTGKAEKLVDSTDPVEEKSLYTDTPIVHKYLKELNAATFGQDPESITVGEMSSTTIANSIEYSKPSEHELSMVFTFHHLKVDYQDGEKWSKMPFDFMKLKELFTEWQEKMDQGDGWNALFWDNHDQPWALTRFGDTGKYRGKSAEMLATATHLMRGTPYIYMGEEIGMIDPDYSSMDDYVDVEAKNAFKALTKKGLSDKEAFEIVKSKARDNSRVPMHWNSEKYAGFSEHKPWLIPTDQEKINVEEELAHGEIFNYYQKLIKLRRSEDLISDGHIKMFLKDDPQVFAYERYLKDSDKKLLVFTNFYGKEHSVKLPEEYQNKEYQVLINNYDTKDSQLTDEIILKPYEALAIKIKQ

SEQ ID NO: 293 - DNA, 831 bp, Lactobacillus acidophilus
  CDS (1)...(831)
  misc_feature (0)...(0): ORF 1440; msmG
atggagaaagaaaataaatcaaagaaattttggaattacgctttattaattgtaggcggaatcctcatattaattcccttactttatacatttttaagttcatttaagacaactaagcaaattatggaacatttctttgcttggcctaatccttggacaacagcaaactttaagaggttatttgctgacggagtaatgaattacttcggtaattcaattatcatcacagttctttcaattgttttagtaatgatcttcgtaccaatggctgcgtatgctattgcaagaaatatgtctaaaaggacagctttcaactggatgtacattctattaattataggtatctttgttccattccaagttatcatgattcctattacagttatgatgagtaaaatcggcctagctaatatgtgggggttgatcatcctgtacttaacatatgcggtaccacagacattgttcttatacgttagctacattaagcaaagtgtgcctgatagtttggatgaagctgcagaaattgacggtgctaataagattaccacttattttaaaattatcttcccattattaaaaccaatgcatgccacaactttaattattaatgcaatgtggttctggaacgatttcatgcttccattattgattttgaacaaagactcaaagatgtggactttaccattattccaatacaactacacaggtcaatacttcaatgactatggtccaagtttcgcatcatacgtaatcggtattatcactatcacaattgtatatttgatcttccaaaagaatattattgctggtatgagtaacggtgctgttaag

SEQ ID NO: 294 - protein, 277 aa, Lactobacillus acidophilus
MEKENKSKKFWNYALLIVGGILILIPLLYTFLSSFKTTKQIMEHFFAWPNPWTTANFKRLFADGVMNYFGNSIIITVLSIVLVMIFVPMAAYAIARNMSKRTAFNWMYILLIIGIFVPFQVIMIPITVMMSKIGLANMWGLIILYLTYAVPQTLFLYVSYIKQSVPDSLDEAAEIDGANKITTYFKIIFPLLKPMHATTLIINAMWFWNDFMLPLLILNKDSKMWTLPLFQYNYTGQYFNDYGPSFASYVIGIITITIVYLIFQKNIIAGMSNGAVK

SEQ ID NO: 295 - DNA, 1254 bp, Lactobacillus acidophilus
  CDS (1)...(1254)
  misc_feature (0)...(0): ORF 1442; msmE
atgaagagatggctgaaaaatataactctaattggagtcatgatggctacagtgataagtttatcagcttgtggtgataagcaaaatagtagctcaggcaaaaaagttactattgagtattttaatcaaaagaaggagatggcaggtactttaaaggaaattattaaagatttcgaaaaaaagaatcctgacattcatgtaaaagaagtcgatgtaccaactgctggtacagtgttgaaaactagaattctatcaggggatgtacctgatgtaatgaatatttatccgcaaaatatcgacttccaagaatgggccaaagctggatattttgaagatatgactaaggcgccatacataaagaacattaaaaataattatgcggattcatttaaagtaaacggcaaaatttatagtgcaccgcttagtgctaatgtttacggttttttctacaatgcgacagaatttgaaaagttaggtattaaaccacccaagacttgggatgaattcaagcaagtagttaagaaaataaaggctagtggaaaatcaccatttgctgtagcaggaactgaaccttggactttaaatggttaccatcaattatctttagcaactgtaaccggtggtgccaagcaagctaacaagttacttagatactcagctccaaacggaattaaggtaaataatccttatattcaaaaagattttactcgtttgaatttacttcgtgaaaatgcacaaaataactggcgtggtgctagttacaacgatgctgttgtttcatttgctactggtaagagtttgattatgccaaacggttcatgggctttgccactgattaaccaacaaaaacctaaatttaaggtaagaaccttcgcattcccagctgcaaaggcaggacatgaaatgaccgtcggttctggtgatcttgcgttgtcaatctcttctaagagtaaacataaaaaggctgccgaaaagtttgttgcctacatgactacaccagctgcaatgcaaaaatactacaacgtagatggtagtccagttgcagttaaaggagtaaagcaaaaaggagttgactctcaattaggtggtttatcaagcttagcatttactaagcacgacatggtttggttggcacaagactggacaagtgaaaatgatttcttcaacttaactgccagttacttgatgacaggtaataaacaacaaatggttaatgatatgaatactttctttaacccaatgaaggctgctgac

SEQ ID NO: 296 - protein, 418 aa, Lactobacillus acidophilus
MKRWLKNITLIGVMMATVISLSACGDKQNSSSGKKVTIEYFNQKKEMAGTLKEIIKDFEKKNPDIHVKEVDVPTAGTVLKTRILSGDVPDVMNIYPQNIDFQEWAKAGYFEDMTKAPYIKNIKNNYADSFKVNGKIYSAPLSANVYGFFYNATEFEKLGIKPPKTWDEFKQVVKKIKASGKSPFAVAGTEPWTLNGYHQLSLATVTGGAKQANKLLRYSAPNGIKVNNPYIQKDFTRLNLLRENAQNNWRGASYNDAVVSFATGKSLIMPNGSWALPLINQQKPKFKVRTFAFPAAKAGHEMTVGSGDLALSISSKSKHKKAAEKFVAYMTTPAAMQKYYNVDGSPVAVKGVKQKGVDSQLGGLSSLAFTKHDMVWLAQDWTSENDFFNLTASYLMTGNKQQMVNDMNTFFNPMKAAD

SEQ ID NO: 297 - DNA, 1587 bp, Lactobacillus acidophilus
  CDS (1)...(1587)
  misc_feature (0)...(0): ORF 1132; ABC transporter
atgacaataagagagctttttaaaagtaatataccgcgttcaatcttaatcattacgctttacgtgttatatgcattttctggtagtttttcgcagtactttcttaaatatgctttaaacggaattactgcaggaaaactagatacatatatttattggcaatttattcaagcaggactagaaattattactgccttgcttctgccaattgcaactgtggtttttaccagacaaacgcaagattatttacatatgattaggaaagacattatgcaccattactatggtgaaggggatgctaagcttgctgatatgcagaatgaactaactgccaatcttaagttacttacaacaaactatgcagccacttgggtcactattttaagtggtatcttggaaattaccattgcaattgctttgttgataagcatgaactggattttgattgtaactacagcaatcttagccgctattactttatctttacctaagataatggagaaaaagacctctataacaatggataaggtaaaccaagagcacagtaaattgctgaatgcgattgaacattggttgggtggtctccaagaattacgtcgttatactgcttatggcagattagctagacaaatgcagaaagttagtggcaattatgttaaggcaaataagcaaaactataaataccgggcaatttctgaaattatcaatggattgggtaatgctttatcacaaatagggatgtcagtcgtggctggtatattattcttgatgcatattatttcatttggtgattttgcggttgctagcagttttgcttttactattttctcaggtatttgggatatcaccaatgctttaaccaaggtgaagtcaactaaggcattacgtgaacaaaccgctgagttacgtaaagccaaaggtatttctaagaaaacagatgcctatggtgttgctgtatctgggttaaaagccaagtataaagaaggagaagagatttcttaccctgactttacaatcaagaaagggcaaaaagttctattggttggtgactcaggtacaggtaaatcttctttgtttaggatgttgctaggtaagcttaagcctgaagctgggcagataactttctttgatcagaacggtcaagctatttctttggataaagcaaaagttggatacttacctcaagatccagttgtctttcctgcaagtattaaagataatatcgtgatgtttaatgataaactgacaaacaagatagctgaagttactcagtcagttcaattacggcctgatttagctaaaatgccagcgggaattgatactgaaatagatttaaagaaagagaatctatcaggtggtcaaagacaaaaggtcgtactagctagaagtgaaattcatgaacagccatttgtcttaatggacgaggtaactagtgctattgaccaaactacaactgaagaaattattgataaactccttcaaacagaccaaacaatcttattaattgcacataactttaccccagaattacaggcaaaatttgatcagataattcaattgaagagtaagaaaggagcagcagaaaaa

SEQ ID NO: 298 - protein, 529 aa, Lactobacillus acidophilus
MTIRELFKSNIPRSILIITLYVLYAFSGSFSQYFLKYALNGITAGKLDTYIYWQFIQAGLEIITALLLPIATVVFTRQTQDYLHMIRKDIMHHYYGEGDAKLADMQNELTANLKLLTTNYAATWVTILSGILEITIAIALLISMNWILIVTTAILAAITLSLPKIMEKKTSITMDKVNQEHSKLLNAIEHWLGGLQELRRYTAYGRLARQMQKVSGNYVKANKQNYKYRAISEIINGLGNALSQIGMSVVAGILFLMHIISFGDFAVASSFAFTIFSGIWDITNALTKVKSTKALREQTAELRKAKGISKKTDAYGVAVSGLKAKYKEGEEISYPDFTIKKGQKVLLVGDSGTGKSSLFRMLLGKLKPEAGQITFFDQNGQAISLDKAKVGYLPQDPVVFPASIKDNIVMFNDKLTNKIAEVTQSVQLRPDLAKMPAGIDTEIDLKKENLSGGQRQKVVLARSEIHEQPFVLMDEVTSAIDQTTTEEIIDKLLQTDQTILLIAHNFTPELQAKFDQIIQLKSKKGAAEK

SEQ ID NO: 299 - DNA, 1575 bp, Lactobacillus acidophilus
  CDS (1)...(1575)
  misc_feature (0)...(0): ORF 1358; ABC transporter
atgggtttaaaagattatctcaaaacaaactatcagcgtgcatttttagtactgtttttaatcacgcttacacaggctgcaactacgctttatacttacttaactagtccagaacttgatgcaatttcacaaggaaaatttattttatttattgaaataatcgcgggtcaattcataattggacagatttgtaattcaagttttaatattgccagcgtgcaaaataccaaacaaacgcaaaatttattccatcaagttcgccaaaatatggttagacattattatcaaaagcctgcccaagtagctgaaatggaaaatcatttgggtaatgatttacaaactattcaatcaagttactatgatatttatttttattttgcgtgtgatttaatttatgtcttttttacaattggtactttatttacctttcattggttacttgtggcatatagtcttttaattacttttttggctattgttgttccaaaattgttagaaaaatatacaaatagagctactgagaaagtttctgaaaagaatgctcaatttttaaacttaattgaaaattggttcaatggtcttgaagaacttagaagatataagaataaaaatatcttgaaaaagaaaattagcgaatcaagtcgtcagcttgaacaaagtgaatttcagcgtgataagacattaatttatgttgaaatggttgcagccatttttgatgttatgggtcgagttggcgtaccggtgcttgcaggagttttgtttttcaatcatcaagtaagcttgggggcaattttaactgctggctattttgctaatggaattttttatagcgtgaatagttgtgtaaccaagtatgctcagcttaaatcaacgagtactttaagaaatcatctggccgaattacaaaaacttaatgctgatgaaaaatttgattcaattgctgaaattgatagggtcgaagtgaaaaatttagcaattcaatatgagcatggagaaaaaattacttatcctaattttgtaattaagcgcggcgaaaaagtattacttacaggcgatagtggcactggtaagtctactttattaaaaacaatgctgggccaaattcaaccaataactggtgaagtgctatataaagataaaacgggaaaaattattcatccagatttgaatcaaattggctatttagcgcaggatttaactatgtttgatgcgactattttggaaaatattacgatgtttaatgcccaattaaaagatcaggttaaagacgtagttagaaataatatttttgccaaagatgaaaaacgctttaaagatggattggctactgagattgaagtgaaacatgatcttctttcaggggggcaacgacagaaggttgttttaatgcgggcgctgatccataaaaaaccgattttgtatttagatgaagctactagtgcaattgatcaagcagcgacaacaaggattttgcaaaatttagtgcagacggatagaactattttgatgattgctcataatttgactaaagagcaaaaagcattattcgatcgtaaaatttacttggagggcaaa

SEQ ID NO: 300 - protein, 525 aa, Lactobacillus acidophilus
MGLKDYLKTNYQRAFLVLFLITLTQAATTLYTYLTSPELDAISQGKFILFIEIIAGQFIIGQICNSSFNIASVQNTKQTQNLFHQVRQNMVRHYYQKPAQVAEMENHLGNDLQTIQSSYYDIYFYFACDLIYVFFTIGTLFTFHWLLVAYSLLITFLAIVVPKLLEKYTNRATEKVSEKNAQFLNLIENWFNGLEELRRYKNKNILKKKISESSRQLEQSEFQRDKTLIYVEMVAAIFDVMGRVGVPVLAGVLFFNHQVSLGAILTAGYFANGIFYSVNSCVTKYAQLKSTSTLRNHLAELQKLNADEKFDSIAEIDRVEVKNLAIQYEHGEKITYPNFVIKRGEKVLLTGDSGTGKSTLLKTMLGQIQPITGEVLYKDKTGKIIHPDLNQIGYLAQDLTMFDATILENITMFNAQLKDQVKDVVRNNIFAKDEKRFKDGLATEIEVKHDLLSGGQRQKVVLMRALIHKKPILYLDEATSAIDQAATTRILQNLVQTDRTILMIAHNLTKEQKALFDRKIYLEGK

SEQ ID NO: 301 - DNA, 672 bp, Lactobacillus acidophilus
  CDS (1)...(672)
  misc_feature (0)...(0): ORF 1838; ABC transporter
atggcagtaattgaattaaaaaatgttaagaagatttatggtaaaggcgatgcgcaagttatagctttacaagatattaattttgttgctaataaaggtgaagttgtcttaataatgggaccatcaggtgcaggaaagagtacatttttaacaatcgctggttctttgcaaaaacctacttcaggtgaggtaataattgatggtgatgatatcggcaacttatcagctaaaaagagtaatgcacttcgcttgactaaaattggttttgtattacaagcatacaatttggttccatttttaacggttgaggaacaatttgttttagtagataaagtcaaaaagcaaaataacctctccaaagatgaattggataagttattaaagcagttaggaattacgaagttattgaaaaaatatcctggggaattatctggtggtcaacaacaaagagcagcaattgcacgtgcactttatgctaatccagaaattcttttggcagatgaacctactgcttcacttgataccaaaaacgttgaagaagtaggacaattatttaaagatctagctaaaaagcgtaataaagctgtgatgttagttactcacgatccgcgtctagaaaaatatgctgatcatatttatgagatgatggatggtaaaatgactcagaaaaaa

SEQ ID NO: 302 - protein, 224 aa, Lactobacillus acidophilus
MAVIELKNVKKIYGKGDAQVIALQDINFVANKGEVVLIMGPSGAGKSTFLTIAGSLQKPTSGEVIIDGDDIGNLSAKKSNALRLTKIGFVLQAYNLVPFLTVEEQFVLVDKVKKQNNLSKDELDKLLKQLGITKLLKKYPGELSGGQQQRAAIARALYANPEILLADEPTASLDTKNVEEVGQLFKDLAKKRNKAVMLVTHDPRLEKYADHIYEMMDGKMTQKK

SEQ ID NO: 303 - DNA, 525 bp, Lactobacillus acidophilus
  CDS (1)...(525)
  misc_feature (0)...(0): ORF 1840; regulator
atggttaagcaaacttttaaaaatttaccgttagctaaacgtaaacgtattgaagatgtattattagaggaatttagtacatatcctttagcaaatgctaaagtatcacatattgtgaaaaaagcagatattgctcgtggtgcattttataaatacttcgatgatttaacagatgcatatatttatatgtattacaaggctattgatactattcatgcaaatatggcaccgggcgaaaaatatgatccagatcatttttacgatcgagttgtaaaatttattgataaaacacaaaacagtaaatttgaaccaatgatgaaattgcatatgtcacaaaatgagtatttgattccagatacttataagatgtattctagacagcttttaaacttagatgctcaaatgtggagtgcaatggttttaagtcatgagataattaatctttgtttatcagatccggaaaatcgtgagaaaaatttagctagatacaaaaagagcttatacatgcttaaaaaggggatggat

SEQ ID NO: 304 - protein, 175 aa, Lactobacillus acidophilus
MVKQTFKNLPLAKRKRIEDVLLEEFSTYPLANAKVSHIVKKADIARGAFYKYFDDLTDAYIYMYYKAIDTIHANMAPGEKYDPDHFYDRVVKFIDKTQNSKFEPMMKLHMSQNEYLIPDTYKMYSRQLLNLDAQMWSAMVLSHEIINLCLSDPENREKNLARYKKSLYMLKKGMD

SEQ ID NO: 305 - DNA, 699 bp, Lactobacillus acidophilus
  CDS (1)...(699)
  misc_feature (0)...(0): ORF 1913; abc transporter
atggcttatatagaaattaaaaataataccaaaacttatcaatcgggcaatacgactatctatgctaataaagatatctctttttctgtaaataaaggcgagttagtcatcattcttggctcatcgggtgctgggaagtctactttgcttaacatccttggaggaatggaacctaataccagcggagacgtaatcgtagctggtcaaaatatcgcaggttataacgccaaacaactaactacctatcgtagaaatgatattggttttgtcttccagttttacaacttaattcctaatctaactgctaaagagaatgtggaactggctgctcaaattgtaccgaacgcaatgagtggtgacgaagctcttaaacaagttgatttagcaaatcgtgctaataattttccagctcaattatccggtggtgaacagcaacgagtagcaattgcccgagccattgctaaaaaacctgctttgcttttatgtgacgagccaacaggggcattagattatcaaactggtaaaagaattttgaagattttacaaaacatgagtcggaaaaatggttctacagttttaatcgttacccataacgctgctatcgcaccaattgctgataaagttattcgtattcatgatggtagtgttaaagatattaaaattaataaaaagcctgctgatataagtacaattgaatgg

SEQ ID NO: 306 - protein, 233 aa, Lactobacillus acidophilus
MAYIEIKNNTKTYQSGNTTIYANKDISFSVNKGELVIILGSSGAGKSTLLNILGGMEPNTSGDVIVAGQNIAGYNAKQLTTYRRNDIGFVFQFYNLIPNLTAKENVELAAQIVPNAMSGDEALKQVDLANRANNFPAQLSGGEQQRVAIARAIAKKPALLLCDEPTGALDYQTGKRILKILQNMSRKNGSTVLIVTHNAAIAPIADKVIRIHDGSVKDIKINKKPADISTIEW

SEQ ID NO: 307 - DNA, 1101 bp, Lactobacillus acidophilus
  CDS (1)...(1101)
  misc_feature (0)...(0): ORF 1938
atgatacaggagatcatcgcctttttaggaagacgcggcgaatttttttacatttcagtttttatgcttctgatgtttttcatatttttaatttcttggttaattgagccgcggcgcttaattaatggggttttatttacaatcttttttatttcagtattcgcttggatcaccgttatgatcaataagagcaccagccgaggattacaacgagcatataatctactattactgatcgttttcttcggtattattctaatactagtttttgcctggctatttcttttttggaatgcctattttgtctggaaatatgagagtcacactttacctaatctattgaccttattttctggttttattgcgttaatctttagcgttatcttcatcttagggccgggacgctatttgcctcattggttaagtgccctactcgcttctattcctgctattgctatttatctaggattagttttatacaactttttagtaaatttgctcttatatcaaatttatcctcgccattacaaacaagactacctaattgttttaggtgcaggactaattaatggtgatcaagtttctaagttactagctgcacgaatcaatcgagcaatccagttctctaatcgccaatatcaaaaaggtagaaaacgtcctattattatcatgtccggtggacaaggtcctgatgaaaaagtacctgaggctttagctatggccaaatttgcacaacaccgtggagtttcaccagatcatattttaattgaagatcaatctaaaaatacttaccaaaatatgcttttttctaagcaactagctactaacgactttgggggtcccaattttaaagcaacattttttagcaacaactaccatatttttagagctgcgcttttagctaaagaagtgggcctaaaagctaatggcgtcggtgcttttactagactctattatttacctaacgcaattattcgtgaatttgctggtgtatttgtcatgcataaacgccgccatttcgttatcatgggagtaatagttttattctttatcttgcaagctattttagctgcagcaggtatcgttaaattcaacgtaatt

SEQ ID NO: 308 - protein, 367 aa, Lactobacillus acidophilus
MIQEIIAFLGRRGEFFYISVFMLLMFFIFLISWLIEPRRLINGVLFTIFFISVFAWITVMINKSTSRGLQRAYNLLLLIVFFGIILILVFAWLFLFWNAYFVWKYESHTLPNLLTLFSGFIALIFSVIFILGPGRYLPHWLSALLASIPAIAIYLGLVLYNFLVNLLLYQIYPRHYKQDYLIVLGAGLINGDQVSKLLAARINRAIQFSNRQYQKGRKRPIIIMSGGQGPDEKVPEALAMAKFAQHRGVSPDHILIEDQSKNTYQNMLFSKQLATNDFGGPNFKATFFSNNYHIFRAALLAKEVGLKANGVGAFTRLYYLPNAIIREFAGVFVMHKRRHFVIMGVIVLFFILQAILAAAGIVKFNVI

SEQ ID NO: 309 - DNA, 1215 bp, Lactobacillus acidophilus
  CDS (1)...(1215)
  misc_feature (0)...(0): ORF 165; multidrug transporter
atgaaaaaagcacatggagaaattcaaaatgatgaaattaagttaatctggctagttgtaggagaattagctacttggattggtgctagttttatttggccattaacttcagtttatttaaataagcaattgcacattagcttgtcgcttatcggtgtagttctattctgcaattgtgccggtaatattctcggctcaattattgcaggtcgtctttatgataagcatgacccgtatcctttaatgctctggggccttggccttgatgcgggcgttttatttctaatggctgcttttcatggctggccagaatactggatttggttaactttgacaggttttcttggcggctggaatggtactttgattaattctgttgccactagtttaaaaaagcatccgggcagatacgtctttaatgttttatacttttcacaaaatttgggtgtggtaactggtactttgattgtgggttacctttatgactattccatcacactcttatttgtaattgcggcacttttattcgtgattgcctttatcaatgcggtctttaattaccgcccaattattatgtttcataaggaaagaattgctaaaggtcaaagcggtaagagtcaaaagatcgaaccaatgcccaagcgcaactttattatgacaatggtcttctttgccatacttggtgttacctggcttatgtatatgaactgggaatcaaacctatcagtttacatggtttcattaggcattccgttccacttatacagtcttctttggactttgaatgctggaattattgtagttatgcagggaattttagcgaaatttcccaatatctttaaaaatttattccatcagattatcttcgggatttgcatgttttcactatcatttattactttagtatttgcaaaagattttgctcattttgccttatcaatgataattttgactctcggtgaatcaactgcatttcctgctattcctgcttatgttaatgacttgtcaccactaactagtaaaggtaaatatcaaggatcaatcatggtggcttctgggattggacgtgcttttggaccattatttggtggtttaattattgatcaagctggttatatttcgttcttttgggtagctgcaattattattgctatgatgattattgtgatgatcccaacttatctaaaattatataaggatttaaaaatctacaaa

SEQ ID NO: 310 - protein, 405 aa, Lactobacillus acidophilus
MKKAHGEIQNDEIKLIWLVVGELATWIGASFIWPLTSVYLNKQLHISLSLIGVVLFCNCAGNILGSIIAGRLYDKHDPYPLMLWGLGLDAGVLFLMAAFHGWPEYWIWLTLTGFLGGWNGTLINSVATSLKKHPGRYVFNVLYFSQNLGVVTGTLIVGYLYDYSITLLFVIAALLFVIAFINAVFNYRPIIMFHKERIAKGQSGKSQKIEPMPKRNFIMTMVFFAILGVTWLMYMNWESNLSVYMVSLGIPFHLYSLLWTLNAGIIVVMQGILAKFPNIFKNLFHQIIFGICMFSLSFITLVFAKDFAHFALSMIILTLGESTAFPAIPAYVNDLSPLTSKGKYQGSIMVASGIGRAFGPLFGGLIIDQAGYISFFWVAAIIIAMMIIVMIPTYLKLYKDLKIYK

SEQ ID NO: 311 - DNA, 558 bp, Lactobacillus acidophilus
  CDS (1)...(558)
  misc_feature (0)...(0): ORF 251; multidrug transporter
atgggagtaaaaatggcagaaaaaagaaataaaaaaatcattctaatgatggcgacacttctgctggggagttttattacgactttagcagaaacgttaatgaacaatggcttgccgatgatcatggaagaaacgcatattagtcagatgaatgcgcaatggcttaataccgggtatatgctggtggcagggatggttatgccactggccacattctttatgcaccgttttcctttgcgccatttgtttactgcaacgatgagtatctttttattgggatcattggttgctacctttgcacctaattttttgtttttgttgattggacgattggtgcaagcaatggtcgtcggaattaacatgccacttgtaaccaatgttttaacgattattattccggctaaaaatagaggtttggcaatcggaatcgctgggatcatcatcaatttaggaccggcgattgggccaactttatcaggagtaattcttgaattttatagttggcgaatgttgtttatcattttgttgccatttacggttttgaccttgatttgtacg

SEQ ID NO: 312 - protein, 186 aa, Lactobacillus acidophilus
MGVKMAEKRNKKIILMMATLLLGSFITTLAETLMNNGLPMIMEETHISQMNAQWLNTGYMLVAGMVMPLATFFMHRFPLRHLFTATMSIFLLGSLVATFAPNFLFLLIGRLVQAMVVGINMPLVTNVLTIIIPAKNRGLAIGIAGIIINLGPAIGPTLSGVILEFYSWRMLFIILLPFTVLTLICT

SEQ ID NO: 313 - DNA, 351 bp, Lactobacillus acidophilus
  CDS (1)...(351)
  misc_feature (0)...(0): ORF 252; multidrug transporter
gtggtttttatcgcaatttttatcaagcgacaattcaagattgaaaatccattacttgatctgcacgtctttgctcgtaaacaatatcgattaggtattttgatcacgttgctgatatctggagcaatcatggcaccagaattgatgttgccactatttagccagaatatcttgaaagttagtccaatagtttcgggtgaggtaatgattccaagtgctttaactatggcttttttatcaccttttgctggaagattatatgataaatttggcattaaaaagatggcagttattggtagtttagcaggattaatcactgcacttccaatgtttttctatgatgcacaaact

SEQ ID NO: 314 - protein, 117 aa, Lactobacillus acidophilus
MVFIAIFIKRQFKIENPLLDLHVFARKQYRLGILITLLISGAIMAPELMLPLFSQNILKVSPIVSGEVMIPSALTMAFLSPFAGRLYDKFGIKKMAVIGSLAGLITALPMFFYDAQT

SEQ ID NO: 315 - DNA, 258 bp, Lactobacillus acidophilus
  CDS (1)...(258)
  misc_feature (0)...(0): ORF 253; multidrug transporter
ttgtgttatacactagcgccagtttatgcattgaatgctttgccgcaaaggagtgttgtttcaggtaatacaattattgtgacaatggtacaggtagctaactcattctgtacggcactagctgtgacaaccaagaatgtggtacaaaatcagacatcatcggttgttagtggctatcaatggtcatttggcactacgattttggtaacatttatcgcgtgtctattgattttaggtattaaaaatcaggctaaacaa

SEQ ID NO: 316 - protein, 86 aa, Lactobacillus acidophilus
MCYTLAPVYALNALPQRSVVSGNTIIVTMVQVANSFCTALAVTTKNVVQNQTSSVVSGYQWSFGTTILVTFIACLLILGIKNQAKQ

SEQ ID NO: 317 - DNA, 519 bp, Lactobacillus acidophilus
  CDS (1)...(519)
  misc_feature (0)...(0): ORF 1062; multidrug transporter
ttgttgttaaatgttgactatgattgtggaacacagtttattttaatatattggtcaattatctatgttgaaaaatttggctttaatttatctgttgtgtacaccttatttatgtttgcgcttattttaggttcaagtatatttaataaattgtctgtattagcaaatacaaagagtattacaattttaaatattacatgtatgatcttagcatttattttaagcgggattatagaaaataaatatttatcgttaattctttttctattgattgaattattgatgggaatgatgtcagggcaaatctctgctactagtaatgaagtaatttatggagaaagtaataaatcaactatgctttctacagtttcgtttattgccgaaattttagttagcttctctttatttataagtaatgcaattatgaaaattgctggtaatttaaaagtgatgttttttgtgtcagcggcttattttagtattactttattgattattcctttgataaaacaaagagaa

SEQ ID NO: 318 - protein, 173 aa, Lactobacillus acidophilus
MLLNVDYDCGTQFILIYWSIIYVEKFGFNLSVVYTLFMFALILGSSIFNKLSVLANTKSITILNITCMILAFILSGIIENKYLSLILFLLIELLMGMMSGQISATSNEVIYGESNKSTMLSTVSFIAEILVSFSLFISNAIMKIAGNLKVMFFVSAAYFSITLLIIPLIKQRE

SEQ ID NO: 319 - DNA, 1755 bp, Lactobacillus acidophilus
  CDS (1)...(1755)
  misc_feature (0)...(0): ORF 597; multidrug transporter
atgaaccatgaagatatttctatagataatggtgctaaagcgaataagtttaaatttagcagctttttcaaattaattaatagtttaaaaccacattattccaaactaattattggaacaattttgggatttattgctacagctgctaatttatttgttcctcaactagcacagcgtttaattaatggctttaaaaatttgagtcctaatttgattattttaacgattgttatttttattggtggattagttattagtgcactatcaggacttattttaggtatttttggtgaagatgttgttgctaaactgcgcaaaaaattatggcaaaaattgctcaatatgcctgtttcatattttgataatactaaaactggtgagataagttcgcgtttagtaaatgatacttcacaggttaaagaattacttgcttcaaccttgcctaatgcaatgacttcaattttacaattttttggtgcattgattattatgatggcaatggattggcagatgacattattaatgtttattggtgtaccattaatcgtcttagctgttatcccaattatgcaaaagtcgcgtagtattgggcgtaaacggcaagatgagttggctaatttttcaagcgattcaaccagtgttttaagcgaaattcgtttggttaaatcatctactggtgaaaaaaaagaactaagagatggtaatcaccgtatcgataatctttatggaattggtgtaaaagaagcttggattagttcacttacttcacctattactaacatgttaatgatgatcatgttcttgggtattttaggttatggcgcaattcgagtaatgaatggttcaatgaccatgggtgcattagtttctttcttaatgtatcttttccaaataatgtctccagtaattattattagtcaattctttaatcgcctttcccaaactagtggttcaacagaaagaatcaaccagattttgcaagaagatgaggaaacaaagactgacaaaaagaagatagatattgctgataagactttaaaatttgaagatgttagttttgaatatgaaaaagataagccaattcttcataacgttaatctaaaggcagaacctaatactgttgtagcttttgctggaccatctggtggtggtaaatcgactatcttttcattaattgaacaattttatcagccaacttctggcaaaattgtaattggtaatactgaaattgatgatattgatttaagtgattggcgtaagcaaattggcttggtagggcaaaattctgcggtaatgcctggcacaattcgtgaaaatttagtttatggattgaataaagatgttaccgaggccgagctatggcgtgttttgaaaatggcatatgctgatcaatttgtaaaagaaatggatgatggacttgatacgcaaattggtgaacgtggaattaaattgtctggaggtcaaaggcaaagaatcgcaattgcgcgtgcatttttacgtgatccaaagattttaatgcttgatgaagcaactgctagccttgattcagaatctgaagcaatggtacaaaaagcattgaataccttaatgaaggatagaactactctagttattgcgcacagattgagtacaattgttgatgccgattgtatttactttattgatcacggaacagtttcaggctctggaactcatgaagaattaatcaagtcaacaccgctttatgcacaatatgttcataatcaatttaagaag

SEQ ID NO: 320 - protein, 585 aa, Lactobacillus acidophilus
MNHEDISIDNGAKANKFKFSSFFKLINSLKPHYSKLIIGTILGFIATAANLFVPQLAQRLINGFKNLSPNLIILTIVIFIGGLVISALSGLILGIFGEDVVAKLRKKLWQKLLNMPVSYFDNTKTGEISSRLVNDTSQVKELLASTLPNAMTSILQFFGALIIMMAMDWQMTLLMFIGVPLIVLAVIPIMQKSRSIGRKRQDELANFSSDSTSVLSEIRLVKSSTGEKKELRDGNHRIDNLYGIGVKEAWISSLTSPITNMLMMIMFLGILGYGAIRVMNGSMTMGALVSFLMYLFQIMSPVIIISQFFNRLSQTSGSTERINQILQEDEETKTDKKKIDIADKTLKFEDVSFEYEKDKPILHNVNLKAEPNTVVAFAGPSGGGKSTIFSLIEQFYQPTSGKIVIGNTEIDDIDLSDWRKQIGLVGQNSAVMPGTIRENLVYGLNKDVTEAELWRVLKMAYADQFVKEMDDGLDTQIGERGIKLSGGQRQRIAIARAFLRDPKILMLDEATASLDSESEAMVQKALNTLMKDRTTLVIAHRLSTIVDADCIYFIDHGTVSGSGTHEELIKSTPLYAQYVHNQFKK

SEQ ID NO: 321 - DNA, 672 bp, Lactobacillus acidophilus
  CDS (1)...(672)
  misc_feature (0)...(0): ORF 1854; multidrug transporter
atgttccttgtatttttgggtactacattctttgttcatgaagaatttactccaatttctcgcgaaaagatgaagccaatgaacgaaattatgaaaagcttgcctagtgtaaaattgatcattgttatgttcataaccactatgcttgttcaatcatcaaccatgtcaattgatccaatcgtttcgctttatgttaaatcaatgatgaccgacggtaaaaatgtagccttggtcgccggtgttgttgccgcaacgccaggacttggtaccttgattgctgcatcaaagattgggcataagatggatgaagttgggcctttgagagttttacgaattggtcttattgttggctttattttatttattccaatggctttgactaataatccatgggtgcttgcaggattaagattcttgctgggaattgctagtgcgggaatgttgccagctgcacagaccgttttaaccttaaacacacctagtgaaagtttcggacggatcttctcttataatcagtcattccaagcaattggtgccgtagtcggctcattaatgggatcgatgatttccggtttatcaaactacgcaacagtattttgggtaactggttttacactattgcttaactttattcttgtattgatctttgcctggggaatttcttatcgcaaa

SEQ ID NO: 322 - protein, 224 aa, Lactobacillus acidophilus
MFLVFLGTTFFVHEEFTPISREKMKPMNEIMKSLPSVKLIIVMFITTMLVQSSTMSIDPIVSLYVKSMMTDGKNVALVAGVVAATPGLGTLIAASKIGHKMDEVGPLRVLRIGLIVGFILFIPMALTNNPWVLAGLRFLLGIASAGMLPAAQTVLTLNTPSESFGRIFSYNQSFQAIGAVVGSLMGSMISGLSNYATVFWVTGFTLLLNFILVLIFAWGISYRK

SEQ ID NO: 323 - DNA, 14 bp, Artificial Sequence
  Consensus sequence for catabolite response element
  misc_feature (3)...(4): n = A, C, T, or G
  misc_feature (6)...(6): n = A, C, T, or G
  misc_feature (9)...(10): n = A, C, T, or G
  misc_feature (12)...(12): n = A, C, T, or G
tgnnwncgnnwnca

SEQ ID NO: 324 - DNA, 14 bp, Artificial Sequence
  Consensus sequence for catabolite response element
  misc_feature (6)...(6): n = A, C, T, or G
  misc_feature (9)...(9): n = A, C, T, or G
  misc_feature (11)...(11): n = A, C, T, or G
tgwaancgntnwca

That which is claimed:

1. An isolated nucleic acid molecule comprising a nucleotide sequence having at least 95% sequence identity across the full length of SEQ ID NO: 175, wherein said nucleotide sequence encodes a polypeptide having lactose permease activity.

2. A vector comprising a nucleic acid molecule comprising a nucleotide sequence having at least 95% sequence identity across the full length of SEQ ID NO: 175, wherein said nucleotide sequence encodes a polypeptide having lactose permease activity.

3. The vector of claim 2, further comprising a nucleic acid molecule encoding a heterologous polypeptide.

4. A microbial host cell comprising a vector comprising a nucleic acid molecule comprising a nucleotide sequence having at least 95% sequence identity across the full length of SEQ ID NO: 175, wherein said nucleotide sequence encodes a polypeptide having lactose permease activity.

5. A method for producing a polypeptide, comprising culturing a cell having a heterologous nucleic acid molecule comprising a nucleotide sequence having at least 95% sequence identity across the full length of SEQ ID NO: 175, wherein said nucleic acid molecule encodes said polypeptide, said polypeptide having lactose permease activity and said cell is cultured under conditions in which the nucleic acid molecule encoding the polypeptide is expressed.

6. The nucleic acid molecule of claim 1, wherein said nucleotide sequence comprises SEQ ID NO: 175.

7. The nucleic acid molecule of claim 1, wherein said nucleotide sequence encodes the polypeptide set forth in SEQ ID NO: 176.

8. The vector of claim 2, wherein said nucleotide sequence comprises SEQ ID NO: 175.

9. The vector of claim 2, wherein said nucleotide sequence is encodes the polypeptide set forth in SEQ ID NO: 176.

10. The microbial host cell of claim 4, wherein said nucleotide sequence comprises SEQ ID NO: 175.

11. The microbial host cell of claim 4, wherein said nucleotide sequence encodes a polypeptide set forth in SEQ ID NO: 176.

12. A microbial host cell comprising a heterologous nucleic acid molecule comprising a nucleotide sequence having at least 95% sequence identity across the full length of SEQ ID NO: 175, wherein said nucleotide sequence encodes a polypeptide having lactose permease activity.

13. The microbial host cell of claim 12, wherein said heterologous nucleic acid molecule comprises a nucleotide sequence comprising SEQ ID NO: 175.

14. The microbial host of claim 12, wherein said heterologous nucleic acid molecule comprises a nucleotide sequence encoding the polypeptide set forth in SEQ ID NO: 176.

15. The method of claim 5, wherein said heterologous nucleic acid molecule comprises a nucleotide sequence comprising SEQ ID NO: 175.

16. The method of claim 5, wherein said heterologous nucleic acid molecule comprises a nucleotide sequence encoding the polypeptide set forth in SEQ ID NO: 176.

* * * * *

UNITED STATES PATENT AND TRADEMARK OFFICE
CERTIFICATE OF CORRECTION

PATENT NO. : 7,459,289 B2  Page 1 of 1
APPLICATION NO. : 11/074226
DATED : December 2, 2008
INVENTOR(S) : Klaenhammer et al.

It is certified that error appears in the above-identified patent and that said Letters Patent is hereby corrected as shown below:

Column 11,
Line 43, "are)" should read --a)-e)--.

Column 39,
Line 63, "cassaya" should read --cassava--.

Column 49,
Line 4, "BgIG" should read --Bg1G--.

Column 72,
Line 7, "NP_806.1" should read --NP_391806.1--.

Signed and Sealed this

Second Day of June, 2009

JOHN DOLL
*Acting Director of the United States Patent and Trademark Office*